US012599645B2

(12) United States Patent　　(10) Patent No.: US 12,599,645 B2
Illingworth et al.　　(45) Date of Patent: Apr. 14, 2026

(54) ANTIBODIES WHICH BIND TO LYSOPHOSPHATIDIC ACID RECEPTOR 1 (LPAR1)

(71) Applicant: DJS ANTIBODIES LTD, Oxford (GB)

(72) Inventors: Joseph Illingworth, Oxford (GB); David Llewellyn, Oxford (GB); Megan Ingham, Oxford (GB); Michael Steward, Oxford (GB)

(73) Assignee: DJS Antibodies Ltd, Oxford (GB)

( * ) Notice: Subject to any disclaimer, the term of this patent is extended or adjusted under 35 U.S.C. 154(b) by 734 days.

(21) Appl. No.: 17/902,449

(22) Filed: Sep. 2, 2022

(65) Prior Publication Data

US 2023/0181671 A1　　Jun. 15, 2023

(30) Foreign Application Priority Data

Sep. 2, 2021　(EP) ..................................... 21194607
Feb. 7, 2022　(EP) ..................................... 22155472

(51) Int. Cl.
*A61K 38/00*　　(2006.01)
*C07K 14/705*　　(2006.01)

(52) U.S. Cl.
CPC ............ *A61K 38/00* (2013.01); *C07K 14/705* (2013.01); *C07K 2317/565* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 6,277,375 B1 | 8/2001 | Ward |
| 8,088,376 B2 | 1/2012 | Chamberlain et al. |
| 9,334,331 B2 | 5/2016 | Igawa et al. |
| 10,421,807 B2 | 9/2019 | Gonzales et al. |
| 2014/0056879 A1 | 2/2014 | Lazar |
| 2024/0123020 A1 | 4/2024 | Illingworth et al. |

FOREIGN PATENT DOCUMENTS

| | | |
|---|---|---|
| EP | 2153847 A1 | 2/2010 |
| WO | WO-97/34631 A1 | 9/1997 |
| WO | WO-98/23289 A1 | 6/1998 |
| WO | WO-2004/029207 A2 | 4/2004 |
| WO | WO-2004/099249 A2 | 11/2004 |
| WO | WO-2006/019447 A1 | 2/2006 |
| WO | WO-2006/053301 A2 | 5/2006 |
| WO | WO-2009/086320 A1 | 7/2009 |
| WO | WO-2018/035107 A2 | 2/2018 |
| WO | WO-2023/031615 A1 | 3/2023 |

OTHER PUBLICATIONS

Booth et al., "Extending human IgG half-life using structure-guided design." *MAbs* 10.7 (2018): 1098-1110.

Borrok et al., "An "Fc-silenced" IgG1 format with extended half-life designed for improved stability." *Journal of Pharmaceutical Sciences* 106.4 (2017): 1008-1017.
Castelino et al., "Amelioration of dermal fibrosis by genetic deletion or pharmacologic antagonism of lysophosphatidic acid receptor 1 in a mouse model of scleroderma." *Arthritis & Rheumatism* 63.5 (2011): 1405-1415.
Chrencik et al., "Crystal structure of antagonist bound human lysophosphatidic acid receptor 1." *Cell* 161.7 (2015): 1633-1643.
Dall'Acqua et al., "Increasing the affinity of a human IgG1 for the neonatal Fc receptor: biological consequences." *The Journal of Immunology* 169.9 (2002): 5171-5180.
Dall'Acqua et al., "Properties of human IgG1s engineered for enhanced binding to the neonatal Fc receptor (FcRn)." Journal of Biological Chemistry 281.33 (2006): 23514-23524.
Datta-Mannan et al., "FcRn affinity-pharmacokinetic relationship of five human IgG4 antibodies engineered for improved in vitro FcRn binding properties in cynomolgus monkeys." *Drug Metabolism and Disposition* 40.8 (2012): 1545-1555.
Datta-Mannan et al., "Monoclonal antibody clearance: impact of modulating the interaction of IgG with the neonatal Fc receptor." *Journal of Biological Chemistry* 282.3 (2007): 1709-1717.
Datta-Mannan et al., "Humanized IgG1 variants with differential binding properties to the neonatal Fc receptor: relationship to pharmacokinetics in mice and primates." *Drug metabolism and disposition* 35.1 (2007): 86-94.
Forbes et al., "Combining liver-and blood-stage malaria viral-vectored vaccines: investigating mechanisms of CD8+ T cell interference." *The Journal of Immunology* 187.7 (2011): 3738- 3750.
Hinton et al., "An engineered human IgG1 antibody with longer serum half-life." *The Journal of Immunology* 176.1 (2006): 346-356.
Hinton et al., "Engineered human IgG antibodies with longer serum half-lives in primates." *Journal of Biological Chemistry* 279.8 (2004): 6213-6216.
Hollevoet et al., "State of play and clinical prospects of antibody gene transfer." *Journal of translational medicine* 15.1 (2017): 1-19.
Igawa et al., "Engineered monoclonal antibody with novel antigen-sweeping activity in vivo." *PloS one* 8.5 (2013): e63236.
Kabat, Sequences of proteins of *immunological interest*. No. 91. US Department of Health and Human Services, Public Health Service, National Institutes of Health, 1991.
Ko et al., "Recent achievements and challenges in prolonging the serum half-lives of therapeutic IgG antibodies through Fc engineering." *BioDrugs* 35.2 (2021): 147-157.
Lee et al., "An engineered human Fc domain that behaves like a pH-toggle switch for ultra-long circulation persistence." *Nature communications* 10.1 (2019): 5031.
Lee et al., "Lysophosphatidic acid receptor 1 inhibitor, AM095, attenuates diabetic nephropathy in mice by downregulation of TLR4/NF-$_\kappa$B signaling and NADPH oxidase." *Biochimica et Biophysica Acta (BBA)—Molecular Basis of Disease* 1865.6 (2019): 1332-1340.
Li et al., "Blocking lysophosphatidic acid receptor 1 signaling inhibits diabetic nephropathy in db/db mice." *Kidney international* 91.6 (2017): 1362-1373.
Liu et al., "Fc-engineering for modulated effector functions-improving antibodies for cancer treatment." *Antibodies* 9.4 (2020): 64.

(Continued)

*Primary Examiner* — Ruixiang Li
(74) *Attorney, Agent, or Firm* — Foley Hoag LLP; Hathaway P. Russell; Tracy L. Vrablik

(57) ABSTRACT

There is provided inter alia polypeptides such as antibodies or fragments thereof which bind to LPAR1.

9 Claims, 41 Drawing Sheets

Specification includes a Sequence Listing.

(56) References Cited

OTHER PUBLICATIONS

Mackness et al., "Antibody Fc engineering for enhanced neonatal Fc receptor binding and prolonged circulation half-life." *MAbs*. 11.7 (2019): 1276-1288.

Miyabe et al., "Abrogation of lysophosphatidic acid receptor 1 ameliorates murine vasculitis." *Arthritis Research & Therapy* 21 (2019): 1-8.

Nishikawa et al., "Therapeutic efficacy of a novel LPA1 receptor antagonist, UD-009, in a bleomycin-induced pulmonary fibrosis model." European Respiratory Journal 48 (2016): PA4032.

Orosa et al., "Lysophosphatidic acid receptor inhibition as a new multipronged treatment for rheumatoid arthritis." *Annals of the rheumatic diseases* 73 (2014): 298-305 (Published online first Mar. 13, 2013).

Palmer et al., "Randomized, double-blind, placebo-controlled, phase 2 trial of BMS-986020, a lysophosphatidic acid receptor antagonist for the treatment of idiopathic pulmonary fibrosis." *Chest* 154.5 (2018): 1061-1069.

Petkova et al., "Enhanced half-life of genetically engineered human IgG1 antibodies in a humanized FcRn mouse model: potential application in humorally mediated autoimmune disease." *International immunology* 18.12 (2006): 1759-1769.

Pradere et al., "LPA1 receptor activation promotes renal interstitial fibrosis." *Journal of the American Society of Nephrology* 18.12 (2007): 3110-3118.

Rancoule et al., "Lysophosphatidic acid impairs glucose homeostasis and inhibits insulin secretion in high-fat diet obese mice." *Diabetologia* 56 (2013): 1394-1402.

Robbie et al., "A novel investigational Fc-modified humanized monoclonal antibody, motavizumab-YTE, has an extended half-life in healthy adults." *Antimicrobial agents and chemotherapy* 57.12 (2013): 6147-6153.

Sakai et al., "LPAR1-induced cytoskeleton reorganization drives fibrosis through CTGF-dependent fibroblast proliferation." FASEB J. 27.5 (2013):1830-1846.

Sasagawa et al., "The significance of plasma lysophospholipids in patients with renal failure on hemodialysis." *Journal of nutritional science and vitaminology* 44.6 (1998): 809-818.

Saunders, "Conceptual approaches to modulating antibody effector functions and circulation half-life." *Frontiers in immunology* 10 (2019): 1296.

Shields et al., "High resolution mapping of the binding site on human IgG1 for FcγRI, FcγRII, FcγRIII, and FcRn and design of IgG1 variants with improved binding to the FcγR." *Journal of Biological Chemistry* 276.9 (2001): 6591-6604.

Swaney et al., "A novel, orally active LPA1 receptor antagonist inhibits lung fibrosis in the mouse bleomycin model." *British journal of pharmacology* 160.7 (2010): 1699-1713.

Swaney et al., "Pharmacokinetic and pharmacodynamic characterization of an oral lysophosphatidic acid type 1 receptor-selective antagonist." *Journal of Pharmacology and Experimental Therapeutics* 336.3 (2011): 693-700.

Tager et al., "The lysophosphatidic acid receptor LPA1 links pulmonary fibrosis to lung injury by mediating fibroblast recruitment and vascular leak." *Nature medicine* 14.1 (2008): 45-54.

Tokumura et al., "Elevated serum levels of arachidonoyl-lysophosphatidic acid and sphingosine 1-phosphate in systemic sclerosis." *International journal of medical sciences* 6.4 (2009): 168.

Vaccaro et al., "Divergent activities of an engineered antibody in murine and human systems have implications for therapeutic antibodies." *Proceedings of the National Academy of Sciences* 103.49 (2006): 18709-18714.

Vaccaro et al., "Engineering the Fc region of immunoglobulin G to modulate in vivo antibody levels." *Nature biotechnology* 23.10 (2005): 1283-1288.

Watanabe et al., "Plasma lysophosphatidic acid level and serum autotaxin activity are increased in liver injury in rats in relation to its severity." *Life sciences* 81.12 (2007): 1009-1015.

Zalevsky et al., "Enhanced antibody half-life improves in vivo activity." *Nature biotechnology* 28.2 (2010): 157-159.

Zhang et al., "Lysophosphatidic acid receptor antagonism protects against diabetic nephropathy in a type 2 diabetic model." *Journal of the American Society of Nephrology: JASN* 28.11 (2017): 3300.

Al Qaraghuli et al., "Antibody-protein binding and conformational changes: identifying allosteric signalling pathways to engineer a better effector response", Scientific reports 10.1: 13696 (2020).

Casset et al., "A peptide mimetic of an anti-CD4 monoclonal antibody by rational design," Biochem Biophys Res Comm, 307:198-205 (2003).

Chen et al., "Selection and analysis of an optimized anti-VEGF antibody: crystal structure of an affinity-matured Fab in complex with antigen", Journal of molecular biology 293.4: 865-881 (1999).

Edwards et al., "The remarkable flexibility of the human antibody repertoire; isolation of over one thousand different antibodies to a single protein, BLyS", Journal of molecular biology 334.1: 103-118 (2003).

Goel et al., "Plasticity within the antigen-combining site may manifest as molecular mimicry in the humoral immune response", The Journal of Immunology 173.12: 7358-7367 (2004).

Holm et al., "Functional mapping and single chain construction of the anti-cytokeratin 8 monoclonal antibody TS1", Molecular Immunology 44.6: 1075-1084 (2007).

Khan et al., "Adjustable locks and flexible keys: plasticity of epitope-paratope interactions in germline antibodies", The Journal of Immunology 192.11: 5398-5405 (2014).

Lloyd et al., "Modelling the human immune response: performance of a 1011 human antibody repertoire against a broad panel of therapeutically relevant antigens," Protein Engineering, Design & Selection, 22(3): 159-168 (2009).

Maccallum et al., "Antibody-antigen interactions: contact analysis and binding site topography", Journal of molecular biology 262.5: 732-745 (1996).

Paul, "Fundamental Immunology", 3rd Edition, Raven Press, NY, pp. 292-295 (1993).

Poosarla et al., "Computational De Novo Design of Antibodies Binding to a Peptide With High Affinity," Biotechnology and Bioengineering, 114(6): 1331-1342 (2017).

Rabia et al., "Understanding and overcoming trade-offs between antibody affinity, specificity, stability and solubility", Biochemical Engineering Journal 137: 365-374 (2018).

Vajdos et al., "Comprehensive functional maps of the antigen-binding site of an anti-ErbB2 antibody obtained with shotgun scanning mutagenesis", Journal of molecular biology 320.2: 415-428 (2002).

Carmona-Rosas et al., "A549 cells as a model to study endogenous LPA1receptor signaling and regulation," European Journal of Pharmacology 815 (2017): 258-265.

International Search Report and Written Opinion for International Application No. PCT/GB22/52240 dated Dec. 16, 2022.

Jung, "Isolation of Single Chain Antibodies Specific to Lysophosphatidic Acid Receptor 1 (LPA1) from a M13 Phage Display Library Using Purified LPA1 Stabilized in Nanodiscs," Bulletin of the Korean Chemical Society 40.7 (2019): 680-685.

Binz et al., "Designing repeat proteins: well-expressed, soluble, and stable proteins from combinatorial libraries of consensus snkyrin repeat proteins," Journal of Molecular Biology 332.2 (2003): 489-503.

Figure 1
A
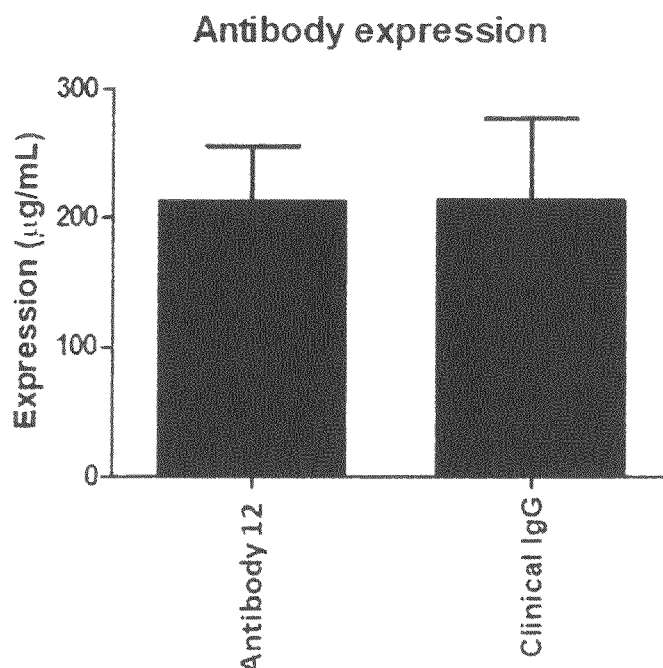
B
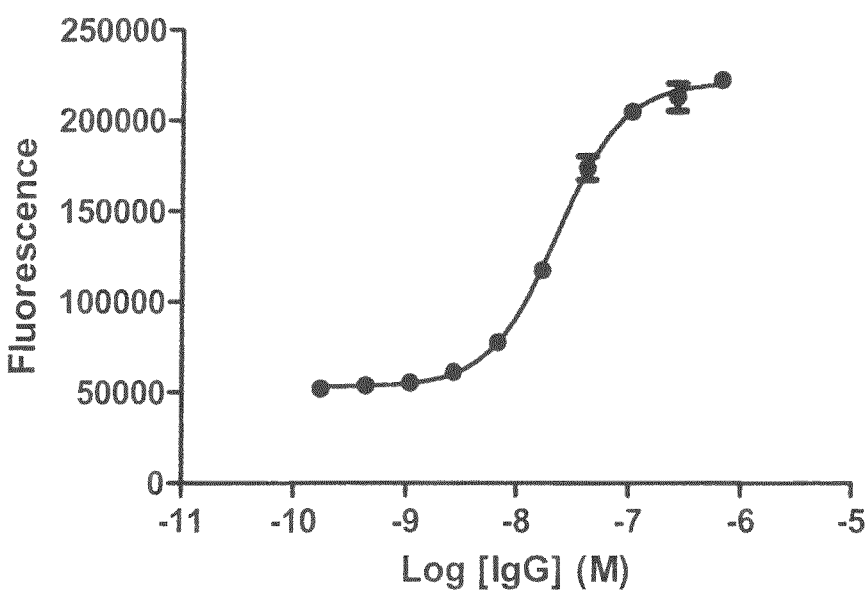

Figure 1 continued
C
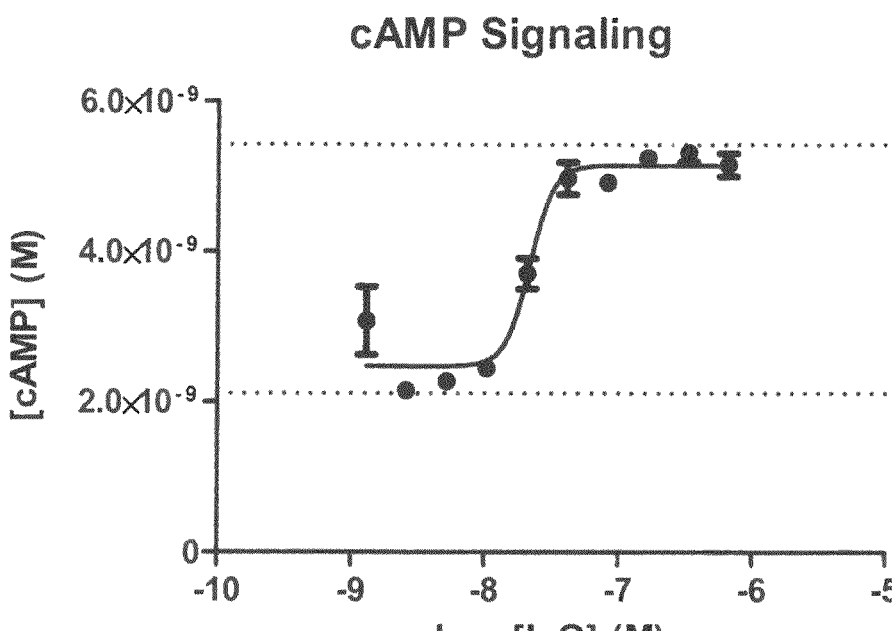
D
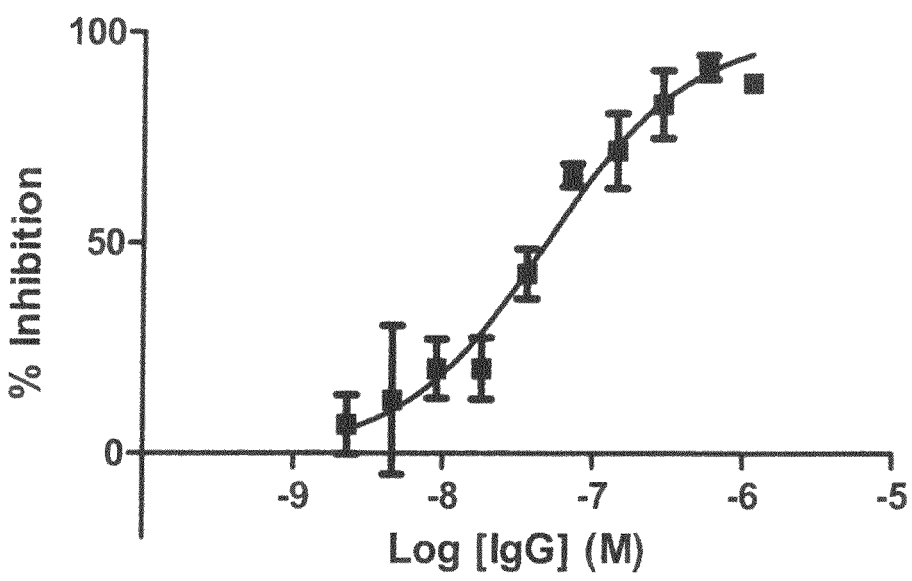

E

Figure 2
A
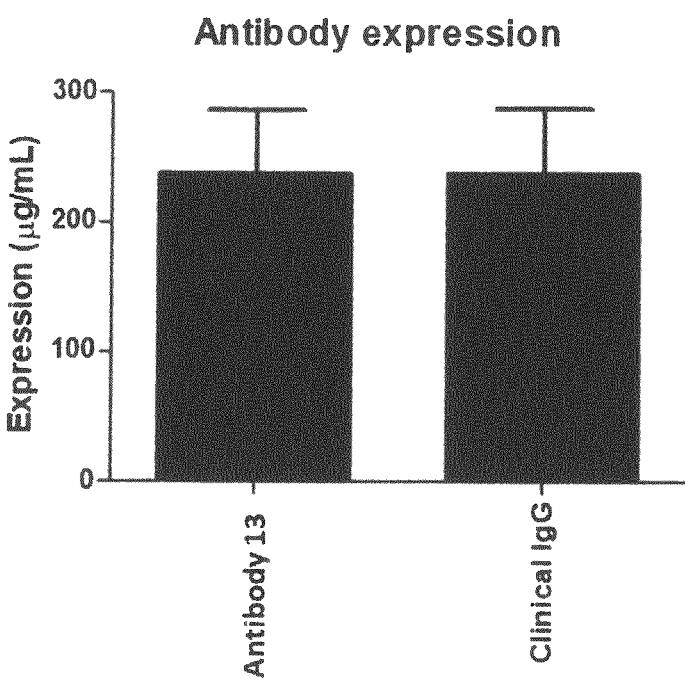
B
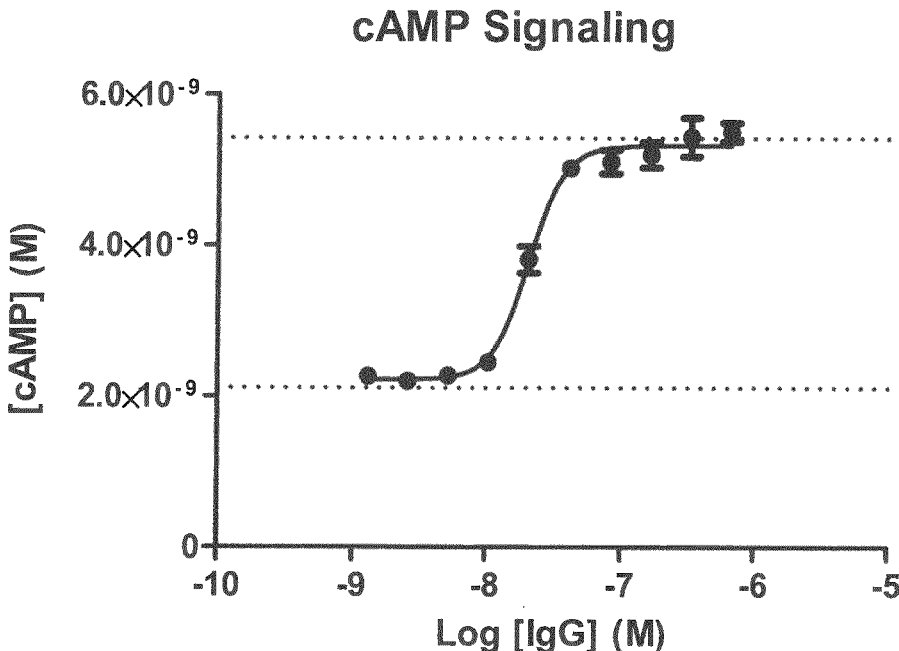

Figure 2 continued
C
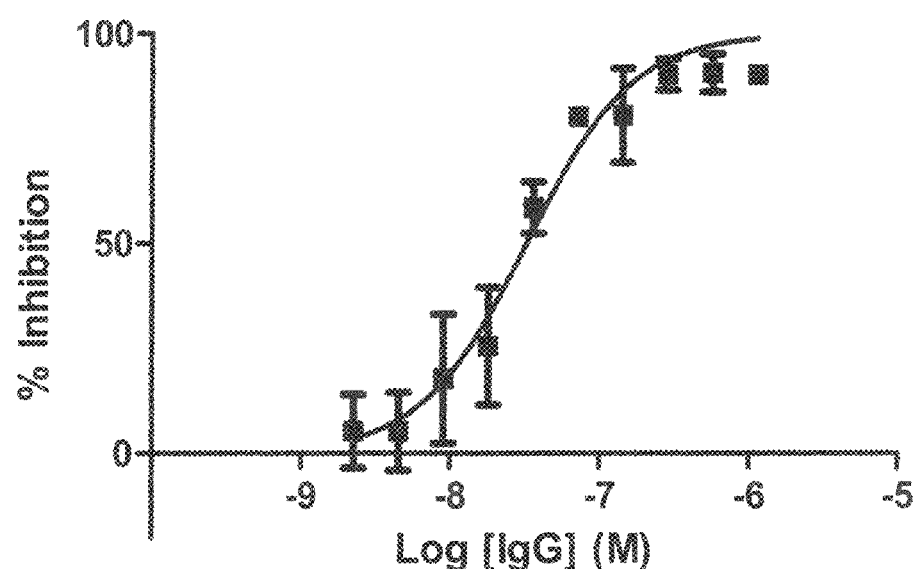
D
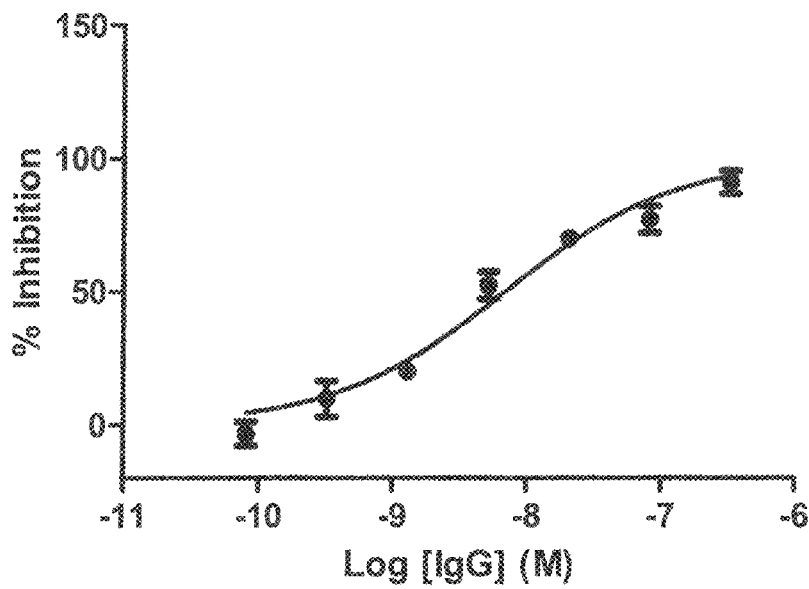

Figure 3

```
                   #<  <      <#   <&&>>####    <<                                                          A
               1~  QCFYNESIAF  FYNRSGKHLA  TEWNTVSKLV  MGLGITVCIF  IMLANLLVMV  ATYVNRRFHF

61~  PIYVLMANLA  AADFFAGLAV  FYLMFNTGPN  TRRLTVSTWL  LRQGLIDTSL  TASVANLLAI

#>>   &><  >
             121~  AIERHITVFR  MQLHTRMSNR  RVVVVIVIW  TMAIVMGAIP  SVGWNCICDI  ENCSNMAPLY

<
             181~  SDSYLVFWAI  FNLVTFVVMN  VLYAHIFGYV  RNRDTMMSLL  KTVVIVLGAF  IICWTPGLVL

<<  >&   <<  <
             241~  LLLDVCCPQC  DVLAYEKFFL  LLAEFNSAMN  PIIYSYRDKE  MSATFRQILG
```

Interaction Regions    Epitope Residues

Region 1               & Very highly probable

Region 2               > Highly probable

Region 3               # Probable

Region 4               < Possible

Figure 4:
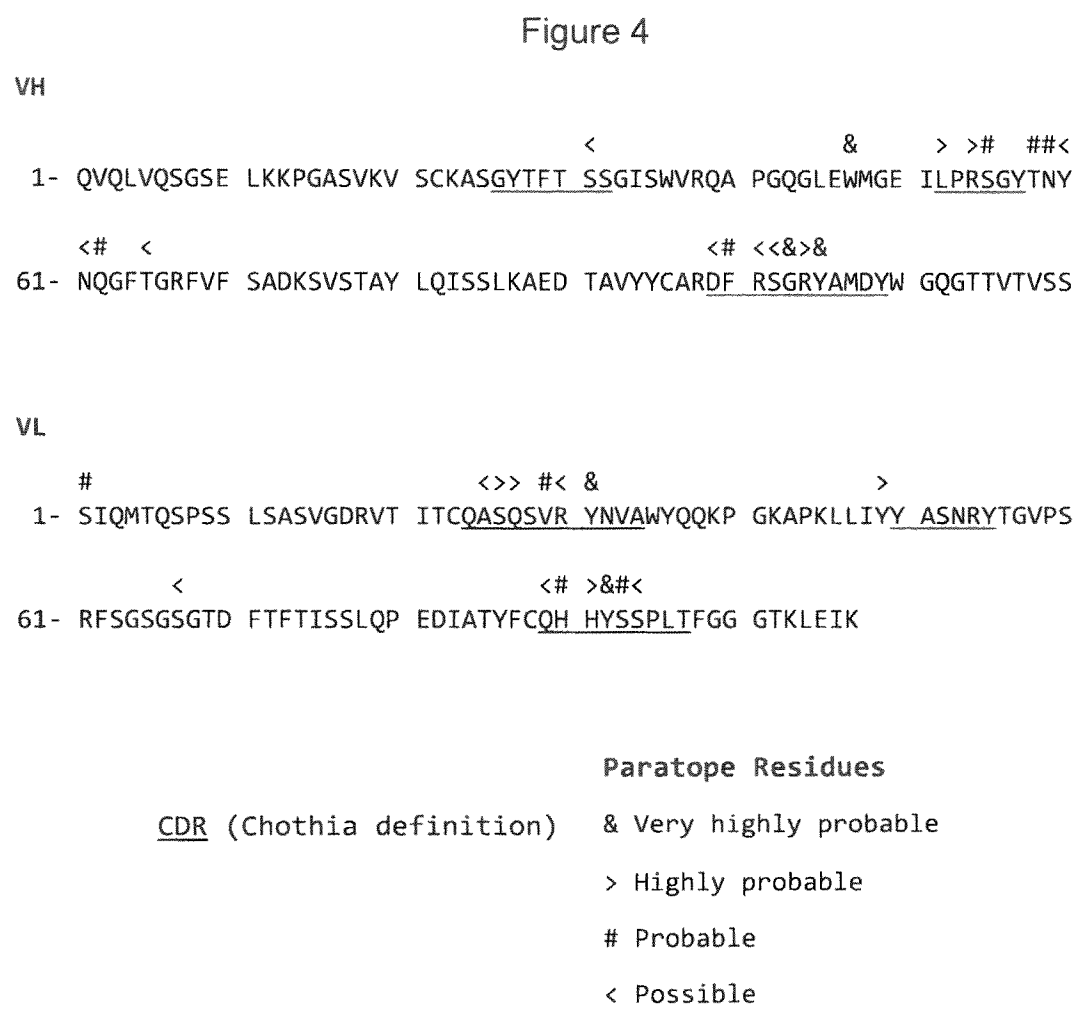

```
                                                    &        > >#  ##<
                               <
1- QVQLVQSGSE LKKPGASVKV SCKASGYTFT SSGISWVRQA PGQGLEWMGE ILPRSGYTNY

<#  <                           <#  <<&>&
61- NQGFTGRFVF SADKSVSTAY LQISSLKAED TAVYYCARDF RSGRYAMDYW GQGTTVTVSS
```

VL

```
                     <>>  #<  &                                ^
1- SIQMTQSPSS LSASVGDRVT ITCQASQSVR YNVAWYQQKP GKAPKLLIYY ASNRYTGVPS

<                                      <#  >&#<
61- RFSGSGSGTD FTFTISSLQP EDIATYFCQH HYSSPLTFGG GTKLEIK
```

Paratope Residues

CDR (Chothia definition)    & Very highly probable

> Highly probable

Probable

< Possible

Figure 5

| Epitope Residue | mAbSilico Prediction | Anti-HA | Anti-LPAR1 | Negative control Ab |
|---|---|---|---|---|
| hLPAR1 | | | | |
| hLPAR1_N35A | Interaction region 1 – Very highly probable | | | |
| hLPAR1_R36A | Interaction region 1 – Very highly probable | | | |
| hLPAR1_T43A | Interaction region 1 – Possible | | | |
| hLPAR1_E44A | Interaction region 1 – Possible | | | |

Figure 5 continued

| Epitope Residue | mAbSilico Prediction | Anti-HA | Anti-LPAR1 | Negative control Ab |
|---|---|---|---|---|
| hLPAR1_N35A_R36A_T43A_E44A | Interaction region 1 | | | |
| hLPAR1_R114A | Interaction region 2 - Probable | | | |
| hLPAR1_R115A | Interaction region 2 – Not highlighted | | | |
| hLPAR1_R114A_R115A | Interaction region 2 | | | |
| hLPAR1_E193A | Interaction region 3 – Very highly probable | | | |

Figure 5 continued

| Epitope Residue | mAbSilico Prediction | Anti-HA | Anti-LPAR1 | Negative control Ab |
|---|---|---|---|---|
| hLPAR1_N194A | Interaction region 3 – Highly probable | | | |
| hLPAR1_E193A_N194A | Interaction region 3 | | | |
| hLPAR1_Q286A | Interaction region 3 - Very highly probable | | | |
| hLPAR1_V289A | Interaction region 4 - Possible | | | |
| hLPAR1_Q286A_V289A | Interaction region 4 | | | |

Figure 7
A
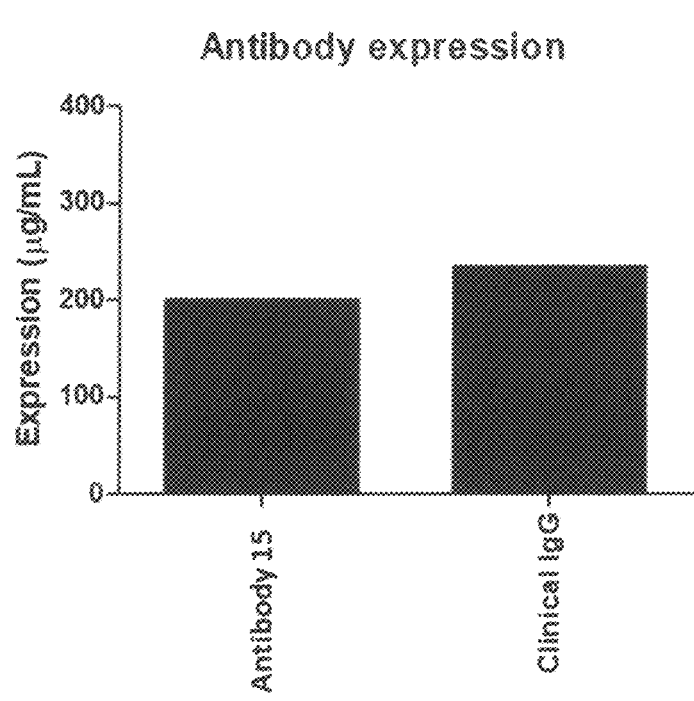
B
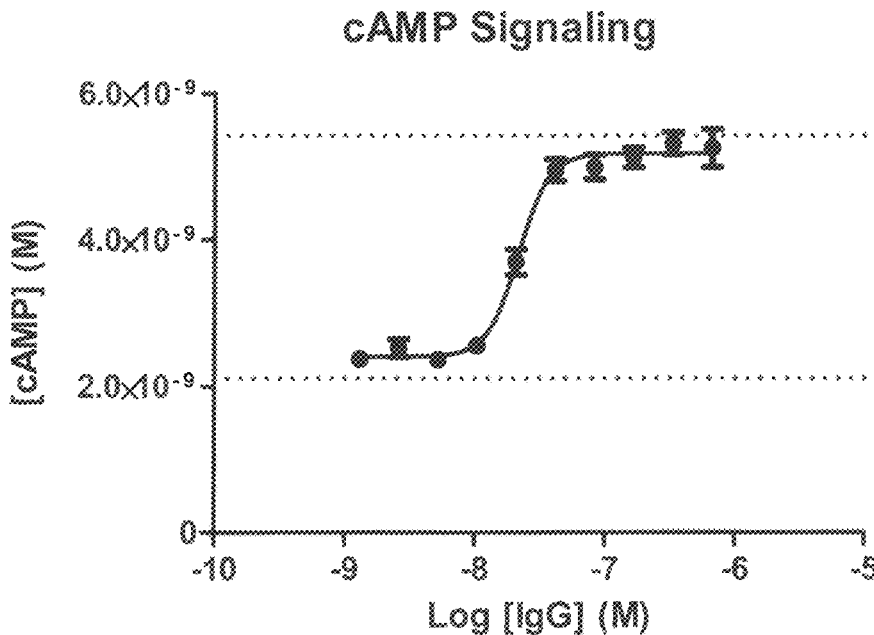

Figure 7 continued
C
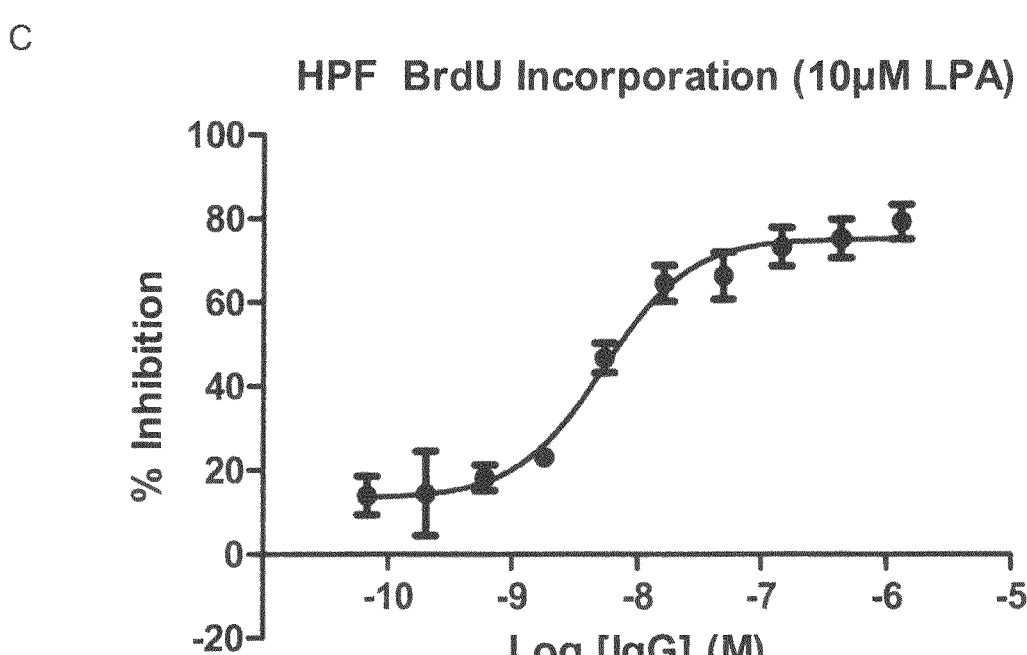
D
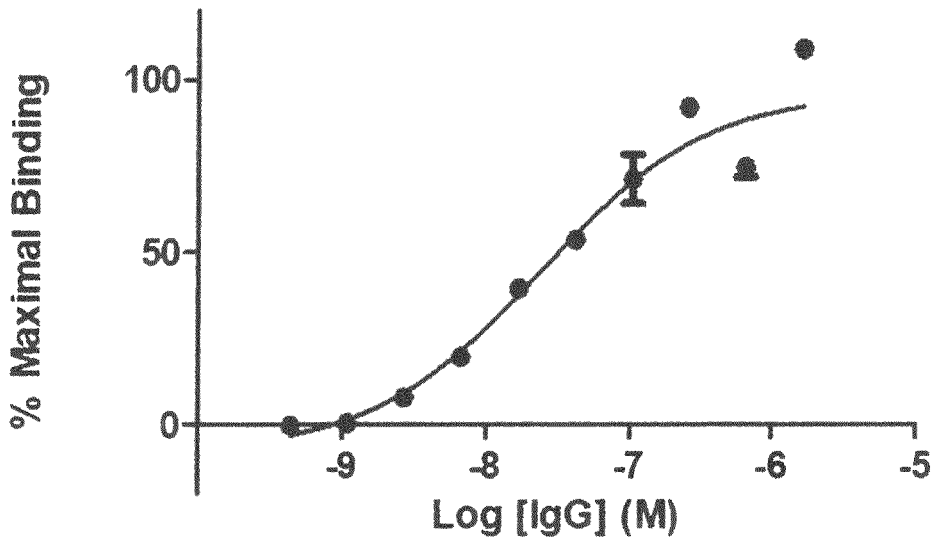

Figure 8
A
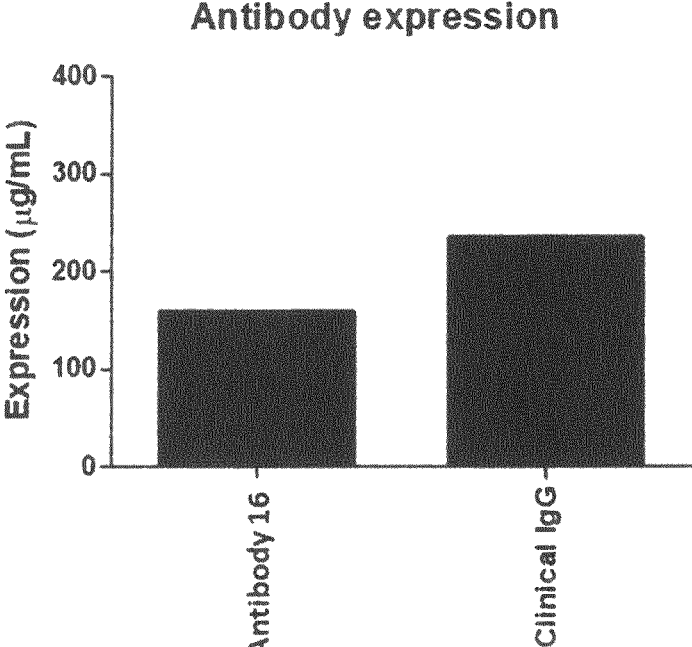
B
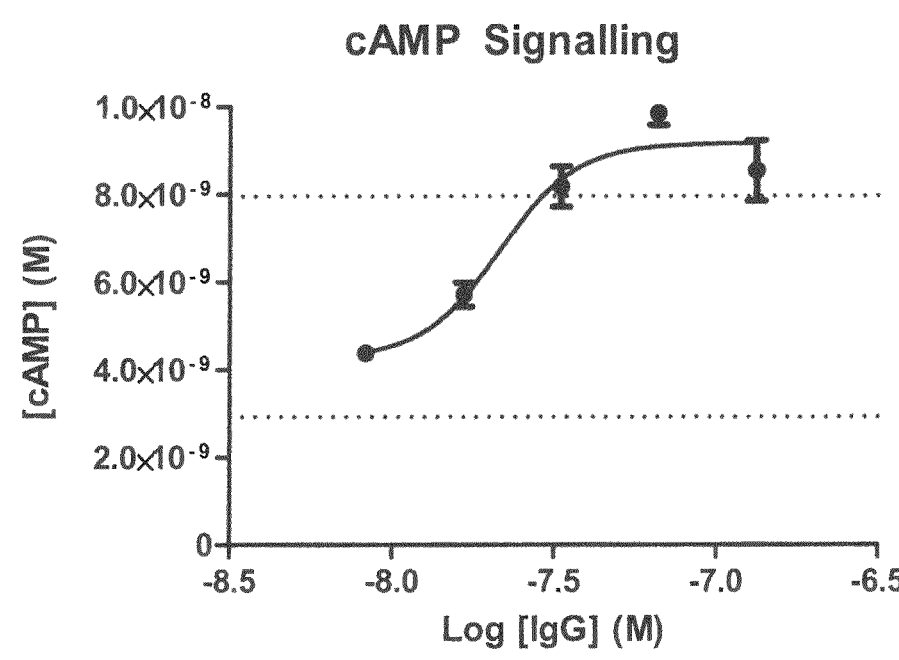

C

Figure 9
A
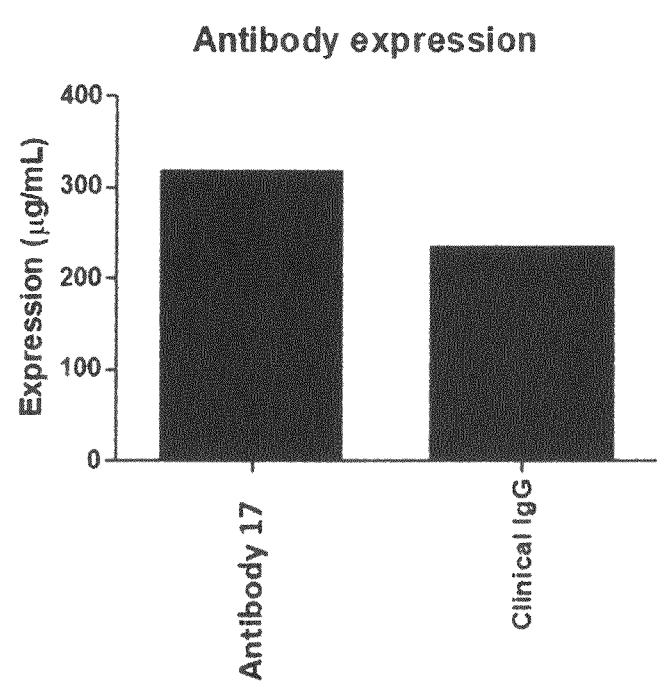
B
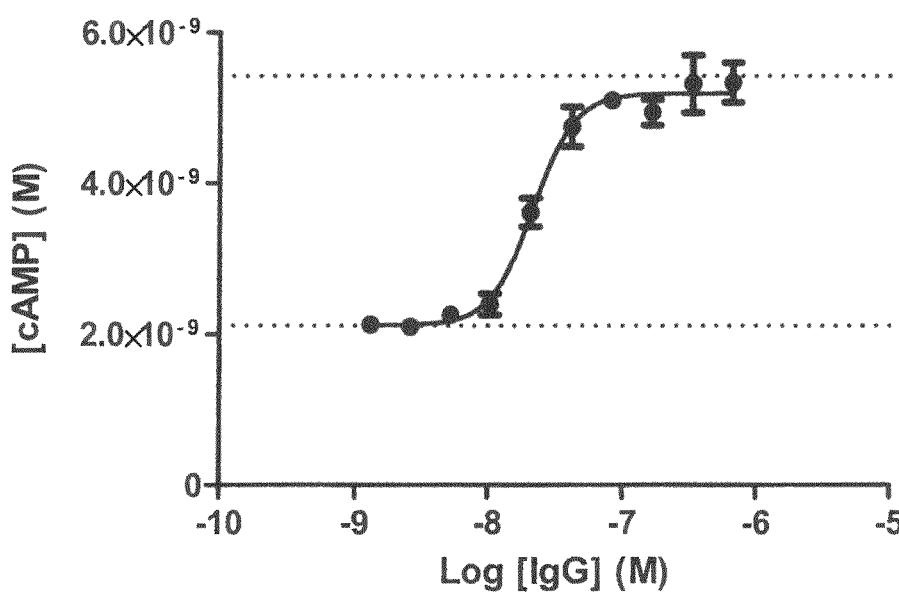

Figure 9 continued
C
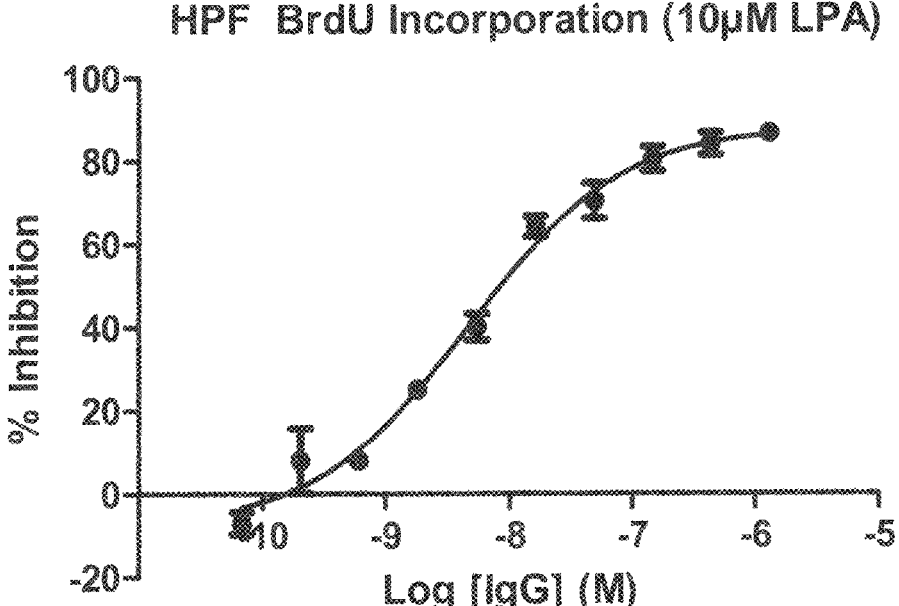
D
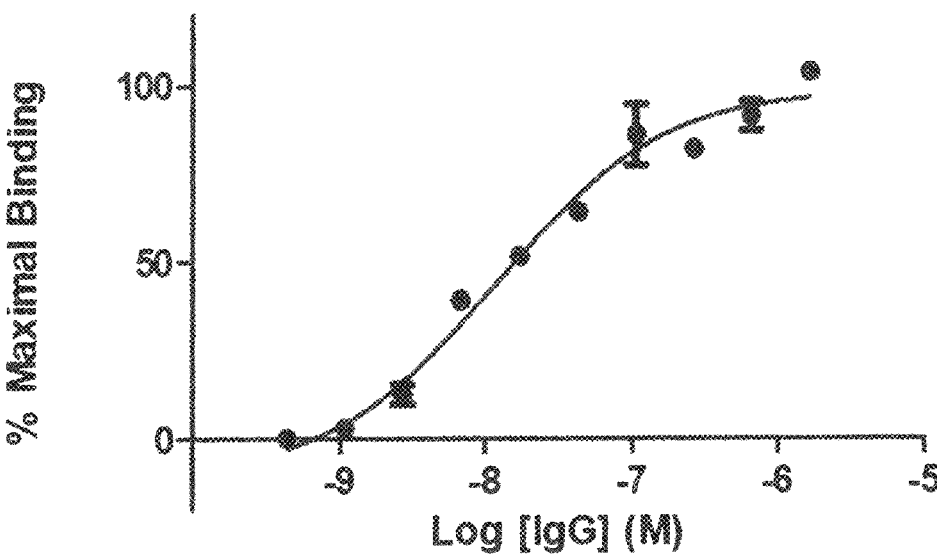

Figure 10
A
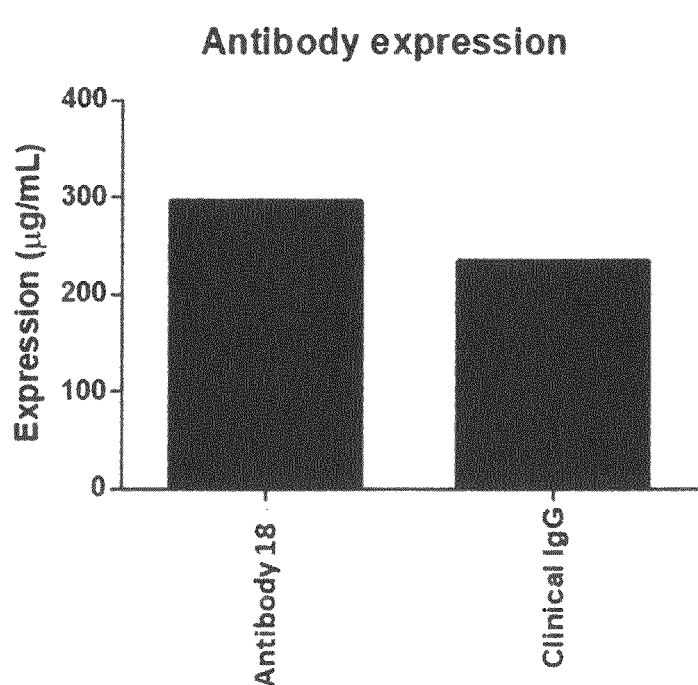
B
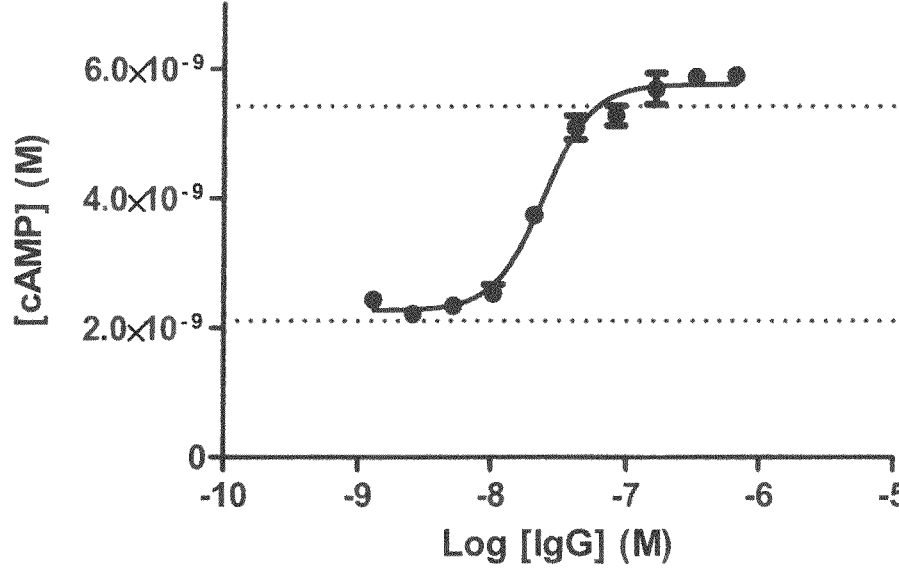

Figure 10 continued
C
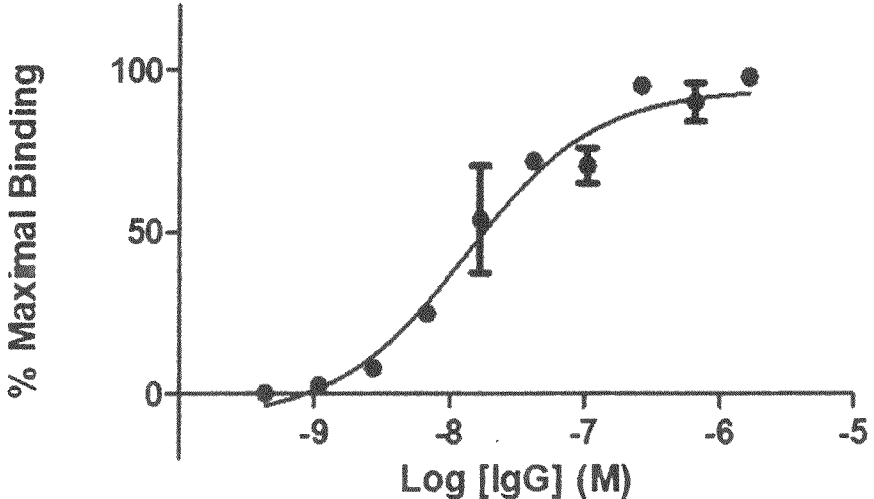
D
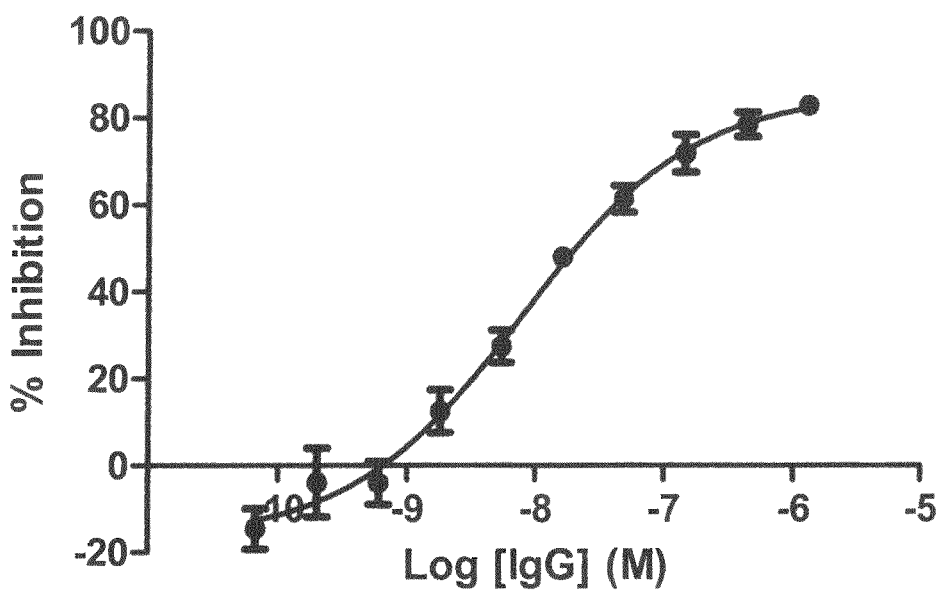

LPAR1

LPAR1

Irrelevant GPCR

Irrelevant GPCR

LPAR1

LPAR1

LPAR1

Irrelevant GPCR

Irrelevant GPCR

Irrelevant GPCR

Figure 13
A
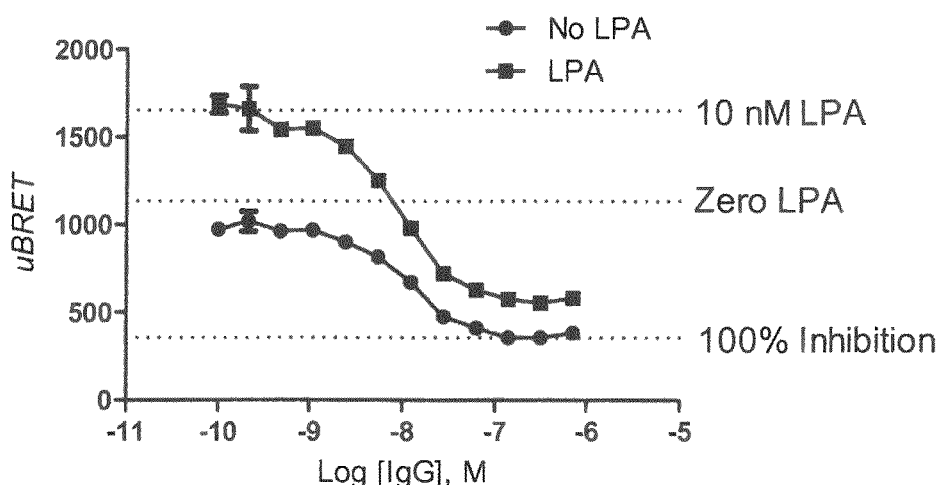
B
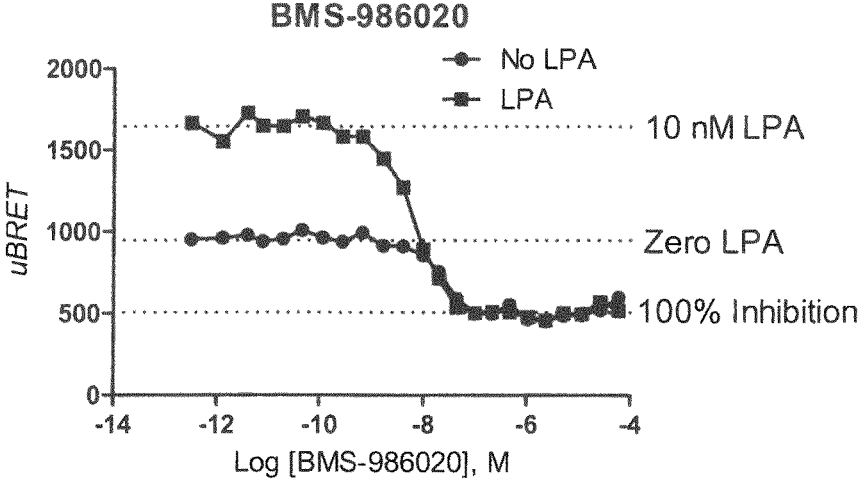

Figure 14
A
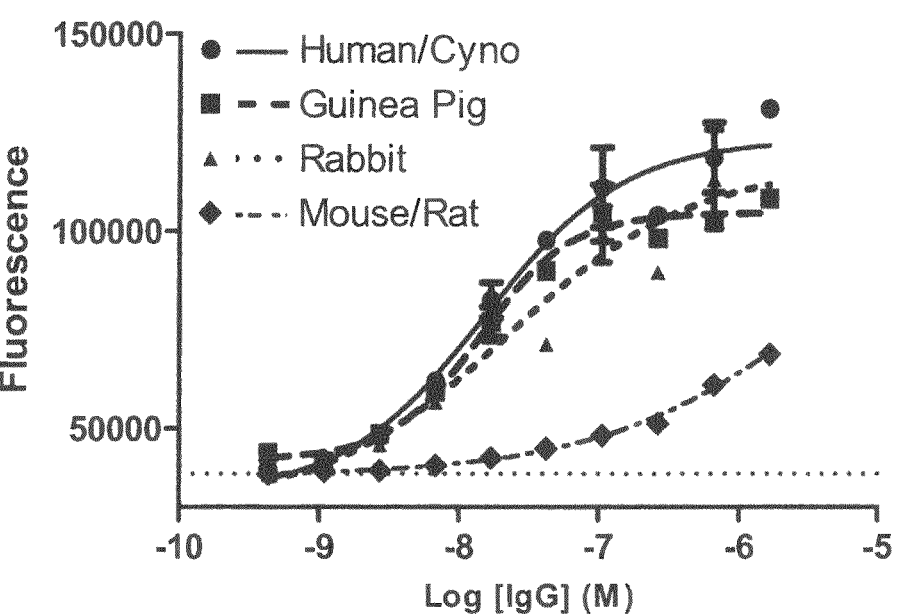
B
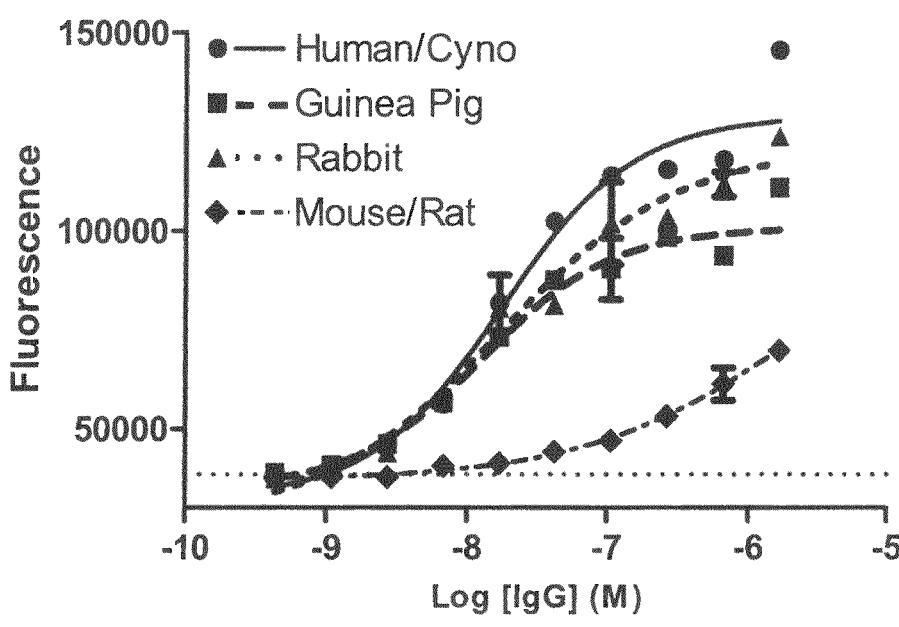

Figure 14 continued
C
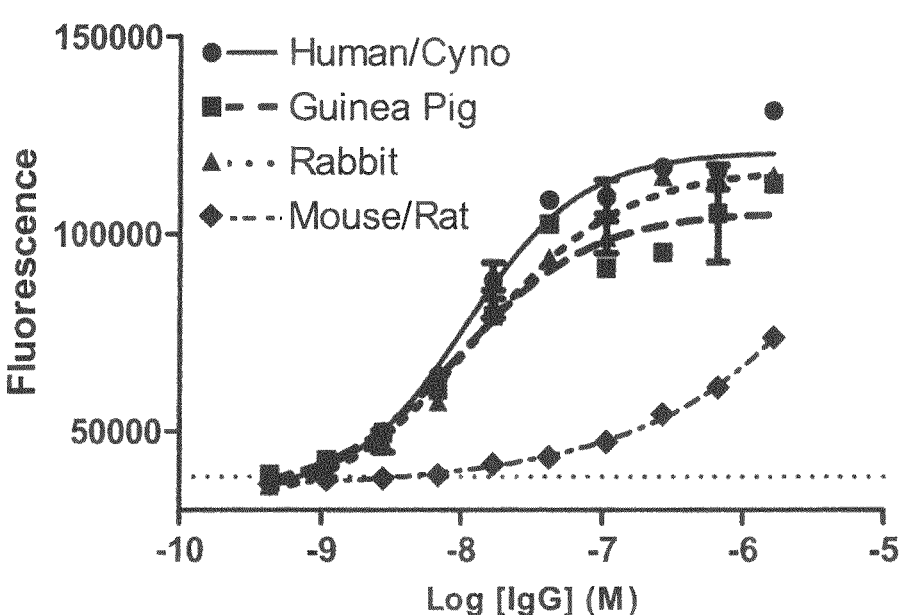
D
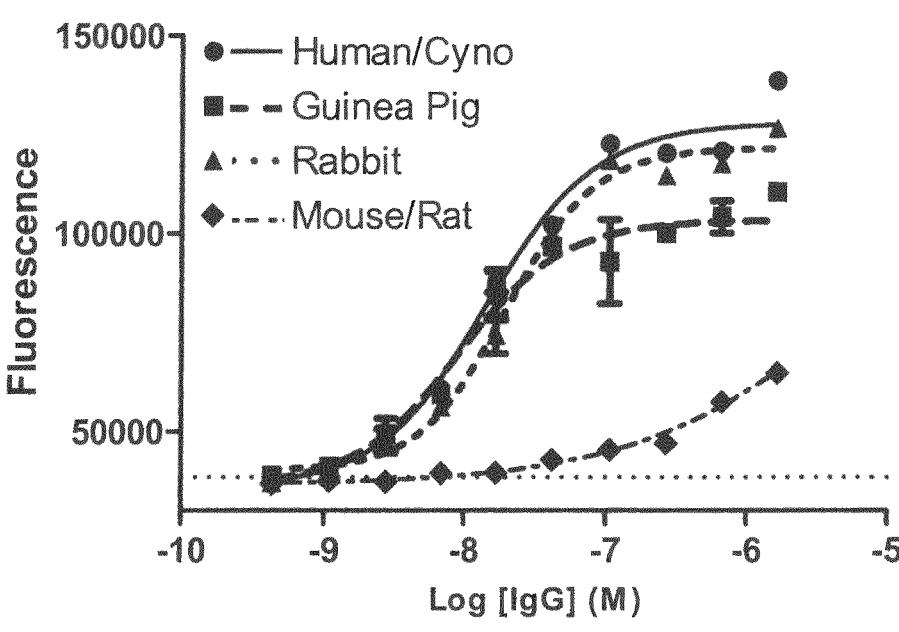

Figure 15
A
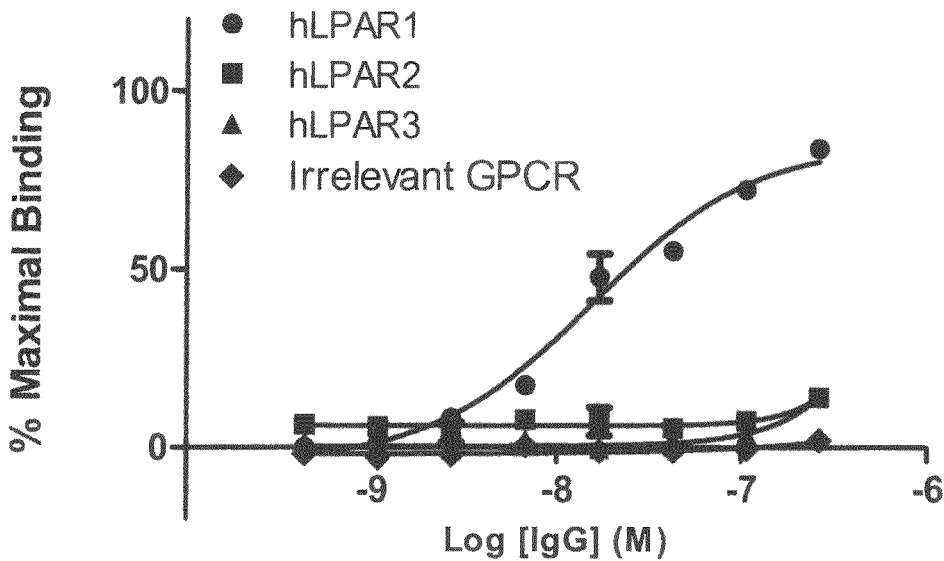
B
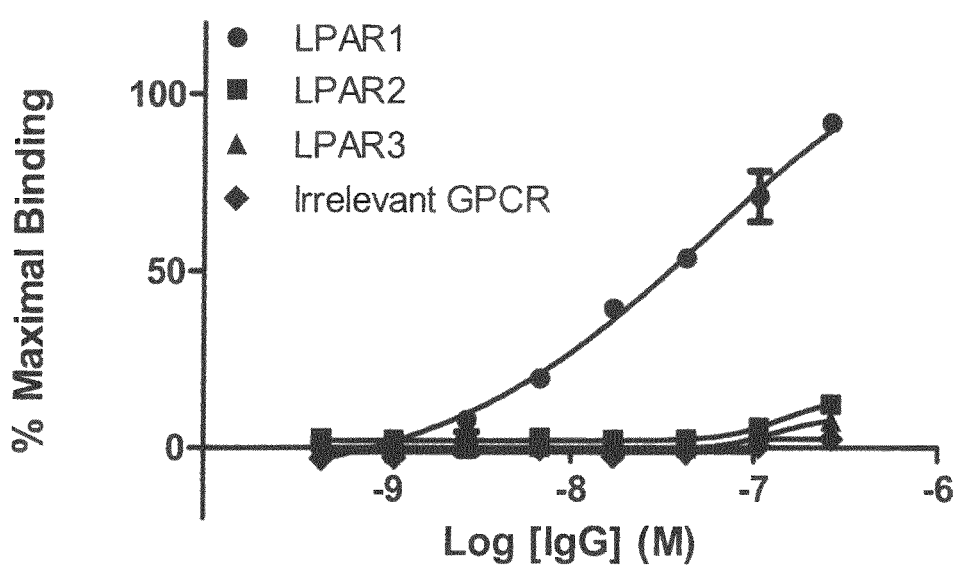

Figure 15 continued
C
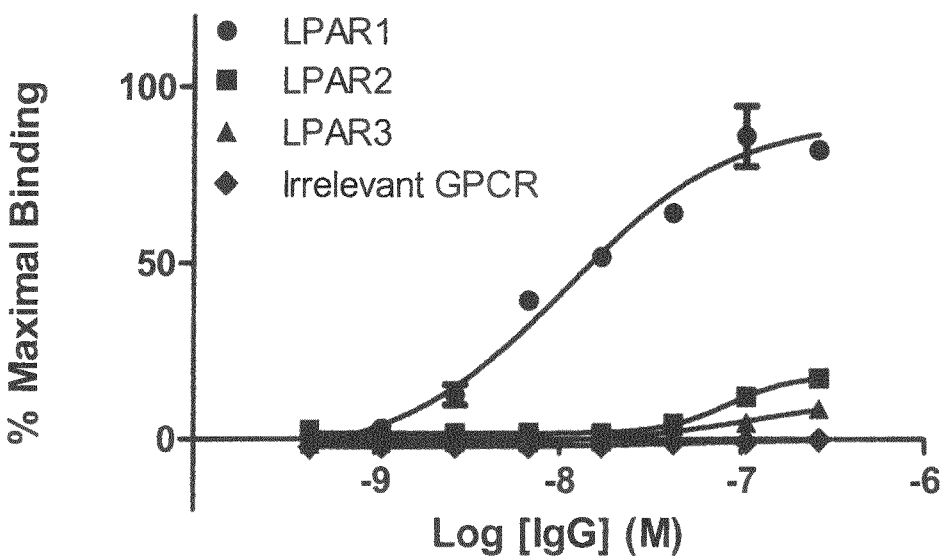
D
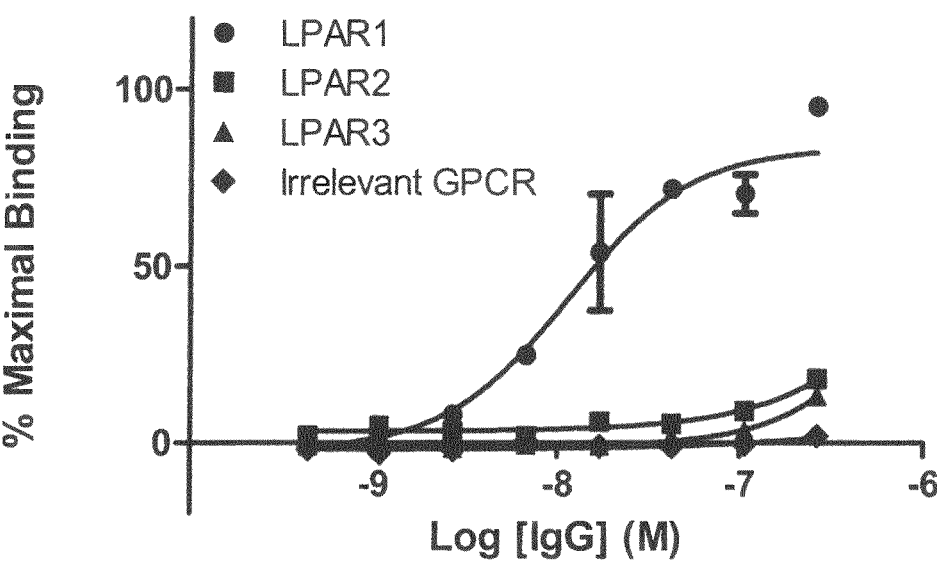

Figure 16
A
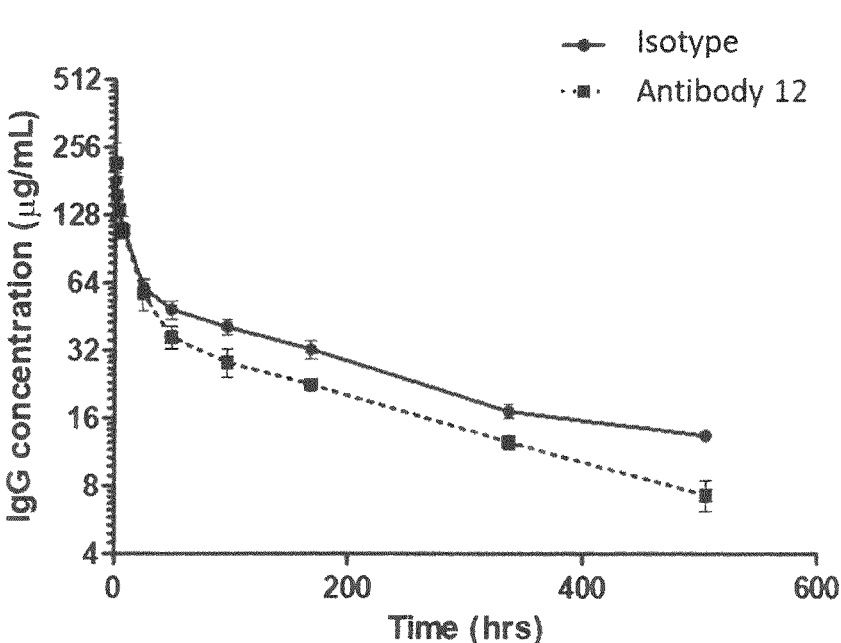
B
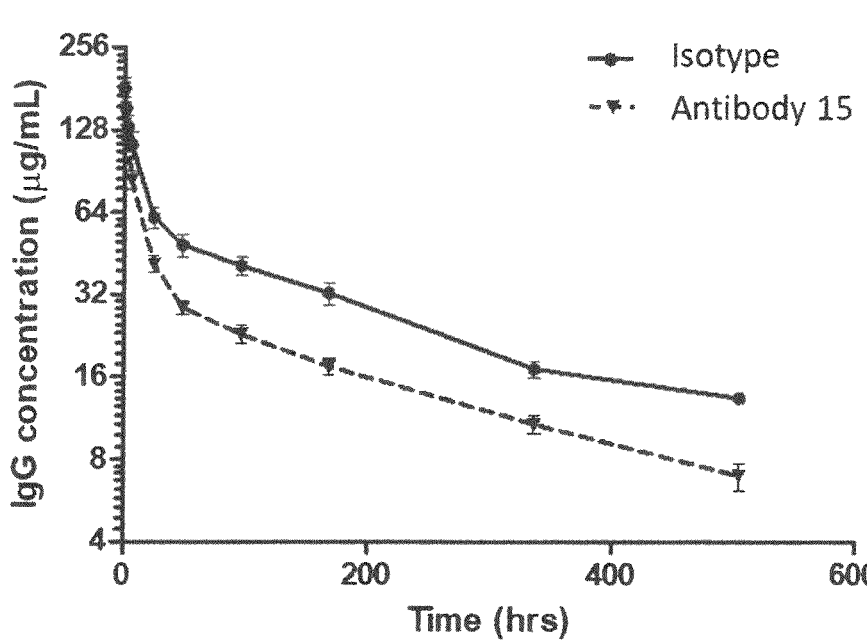

Figure 16 continued
C
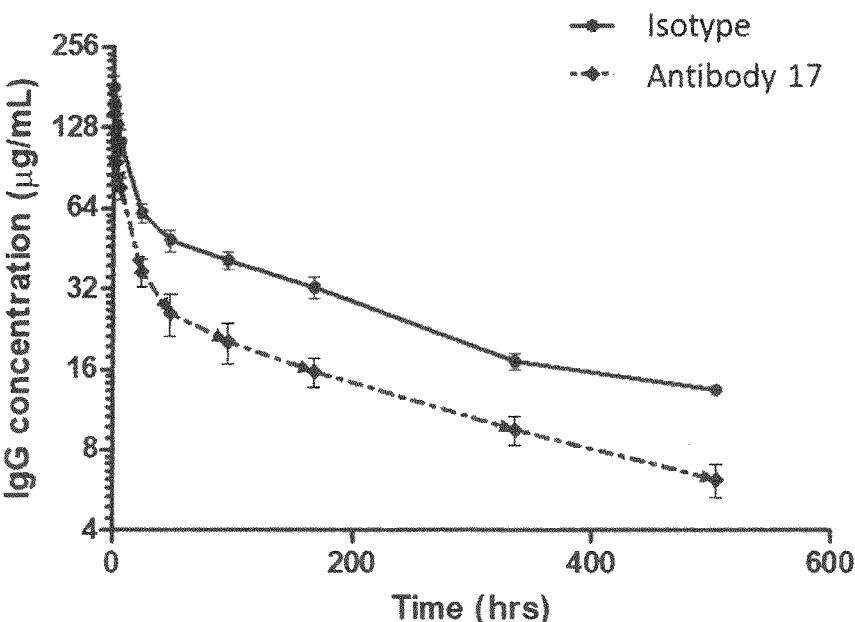
D
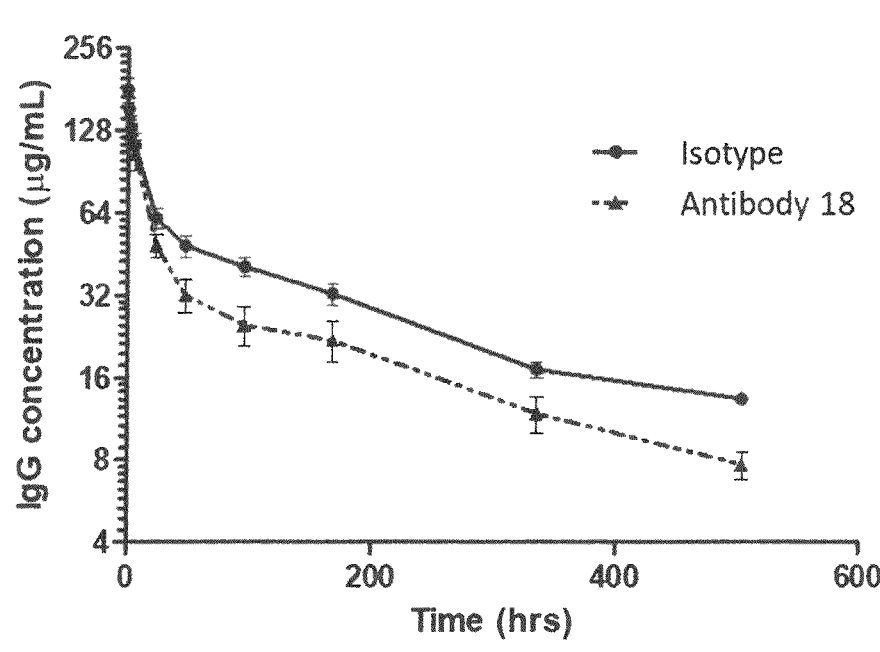

Figure 17
A
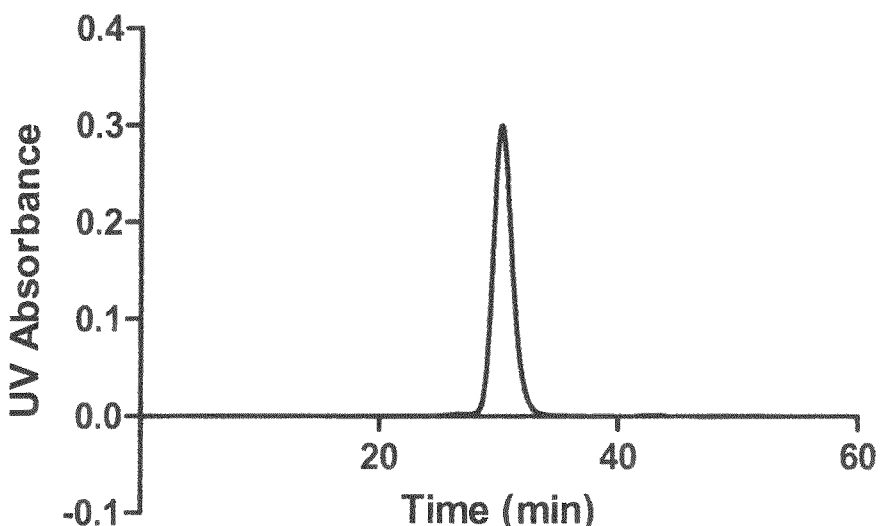
B
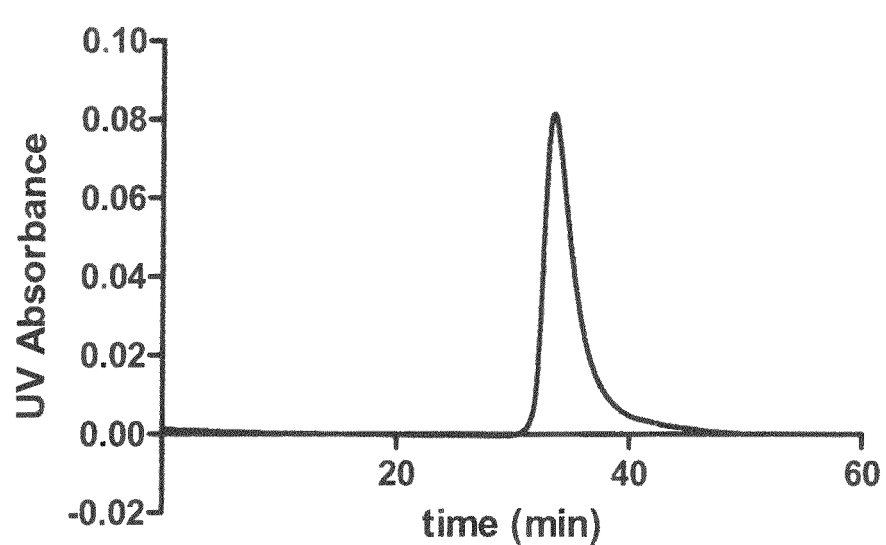

Figure 17 continued
C
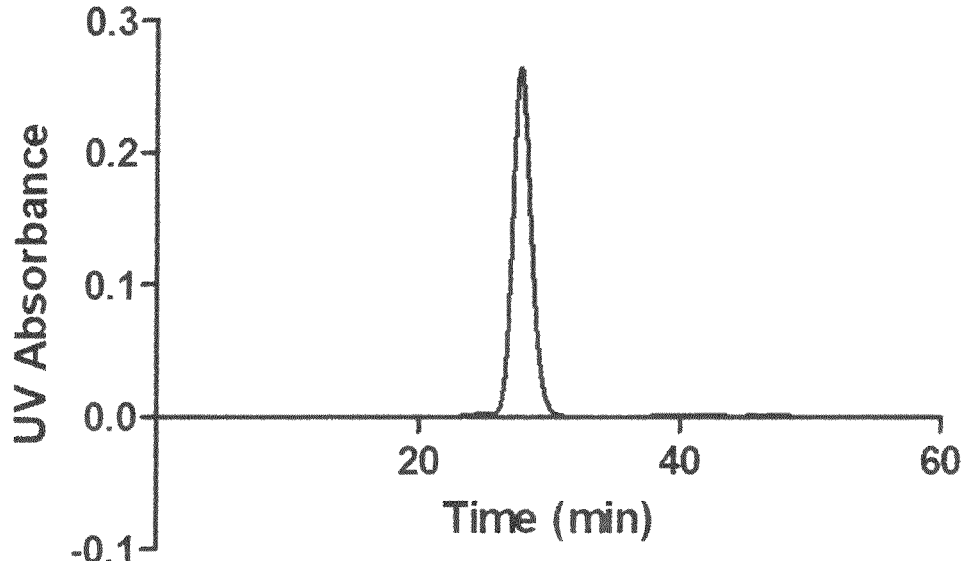
D
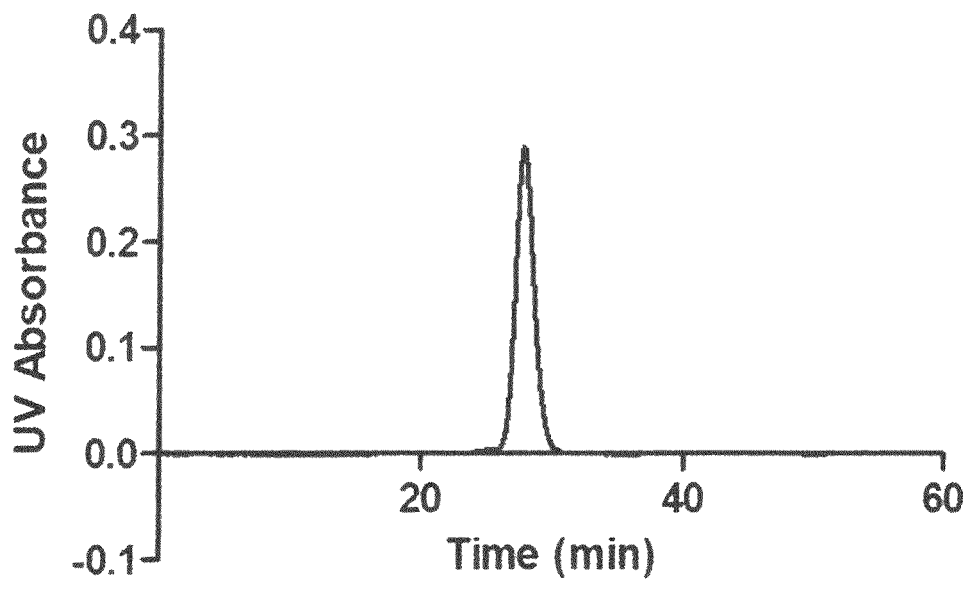

Figure 17 continued
E
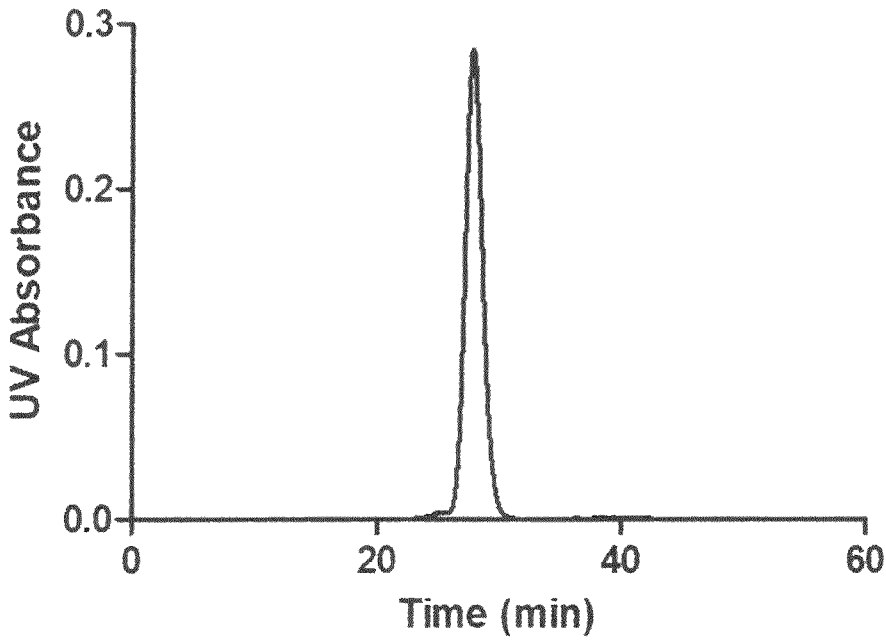
F
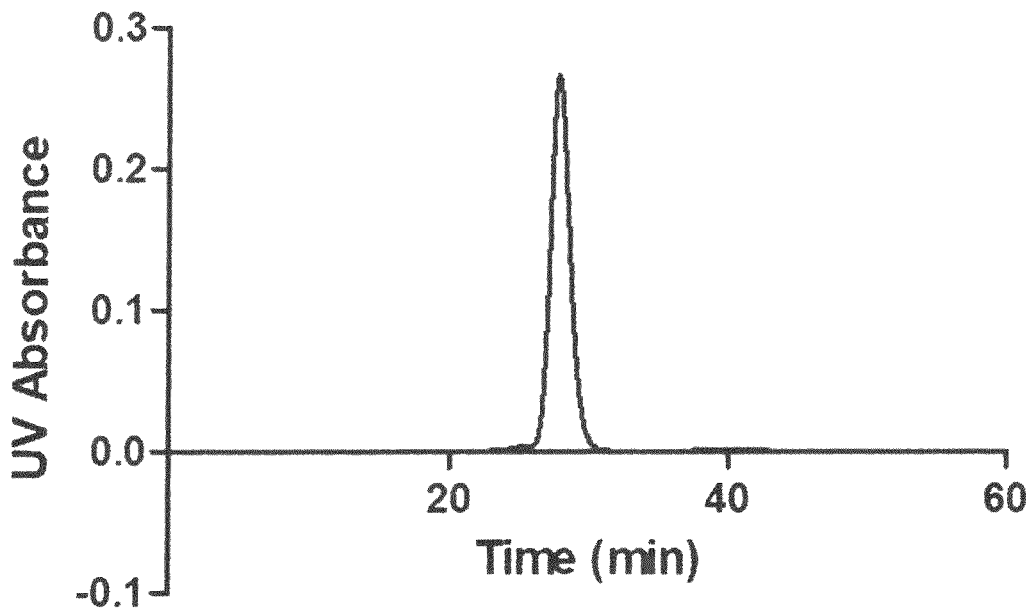

Figure 18
A
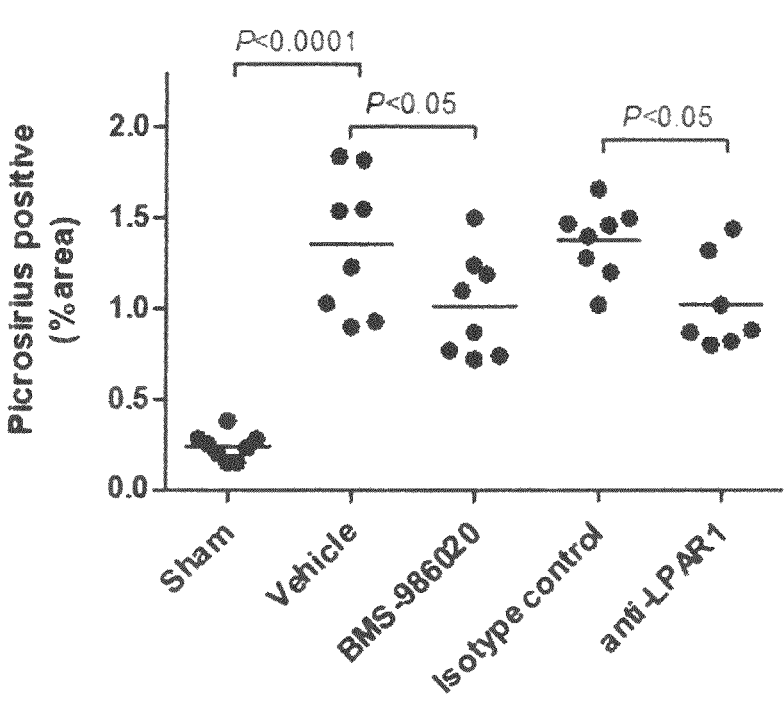
B
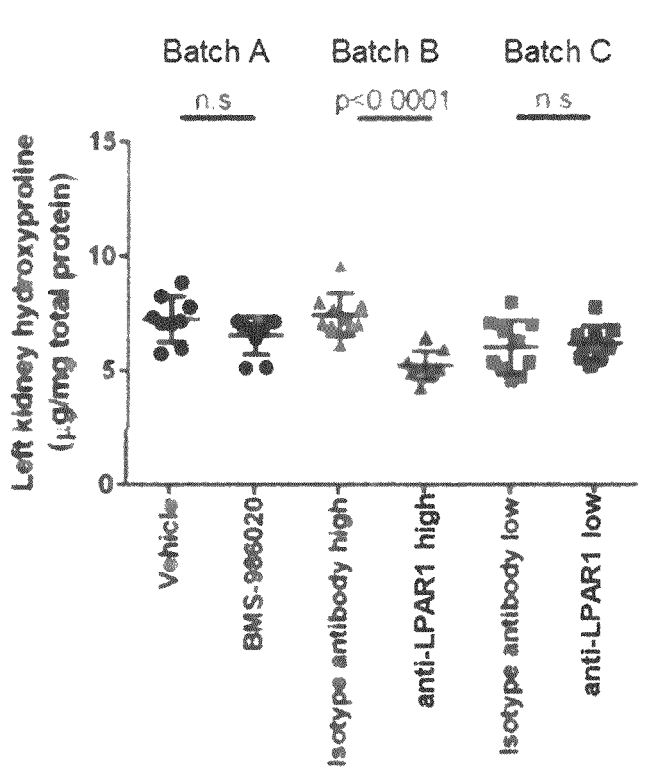

ANTIBODIES WHICH BIND TO LYSOPHOSPHATIDIC ACID RECEPTOR 1 (LPAR1)

CROSS-REFERENCE TO RELATED APPLICATIONS

This application claims the benefit of priority to EP Patent Application No. 21194607.4, filed Sep. 2, 2021, and EP Patent Application No. 22155472.8, filed Feb. 7, 2022, the entire disclosures of which are incorporated herein by reference.

SEQUENCE LISTING

This application contains a Sequence Listing, which was submitted in XML format via EFS-Web, and is hereby incorporated by reference in its entirety. The XML copy, created on Aug. 31, 2022, is named "2022-8-31_DJS-P3047PCT_Sequence_Listing_FINAL.xml" and is 1,888,074 bytes in size.

FIELD OF THE INVENTION

The present invention relates to polypeptides which bind to Lysophosphatidic Acid Receptor 1 ('LPAR1') as well as to constructs and compositions comprising these polypeptides. The present invention also relates to nucleic acids encoding such polypeptides, to methods for preparing such polypeptides, to vectors comprising nucleic acids encoding such polypeptides, to host cells expressing or capable of expressing such polypeptides and to uses of such polypeptides, compositions or constructs.

BACKGROUND OF THE INVENTION

LPAR1 is involved in several biological axes important in diseases such as inflammatory and/or fibrotic diseases. The previously leading small molecule drug to LPAR1 (BMS-986020) failed in Phase II clinical trials due to poor drug selectivity. There is therefore a need for new LPAR1 inhibitors.

SUMMARY OF THE INVENTION

According to a first aspect of the invention, there is provided a polypeptide which binds to Lysophosphatidic Acid Receptor 1 (LPAR1 or LPA1). Suitably, the polypeptide is an antibody or fragment thereof and more suitably the polypeptide binds to functionally active LPAR1 on the surface of a live cell.

This is a significant advancement to the field. To the author's knowledge, no polypeptide which binds to functionally active LPAR1 on the surface of a live cell, and in particular no inhibitor polypeptide which binds to functionally active LPAR1 on the surface of a live cell, has been disclosed in the art. Surprisingly, the present inventors have been able to produce such polypeptides.

Also provided is a polypeptide (such as an antibody or fragment thereof) which binds to LPAR1 wherein the polypeptide comprises a HCDR1, HCDR2, HCDR3, LCDR1, LCDR2 and LCDR3 wherein HCDR1 comprises or consists of a sequence having at least 80% identity with SEQ ID NO: 1, 7 or 107, HCDR2 comprises or consists of a sequence having at least 80% identity with SEQ ID NO: 2, 8 to 11, 100 or 108, HCDR3 comprises or consists of a sequence having at least 80% identity with SEQ ID NO: 3, 12 to 15, 101 or 109, LCDR1 comprises or consists of a sequence having at least 80% identity with SEQ ID NO: 4, 16 to 18, 103 or 110, LCDR2 comprises or consists of a sequence having at least 80% identity with SEQ ID NO: 5, 19, 98 or 111 and LCDR3 comprises or consists of a sequence having at least 80% identity with SEQ ID NO: 6, 20 to 22 or 112.

Also provided is a polypeptide (such as an antibody or fragment thereof) which binds to LPAR1 comprising a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 3, LCDR1 comprises or consists of a sequence having at least 80% identity with SEQ ID NO: 4, LCDR2 comprises or consists of a sequence having at least 80% identity with SEQ ID NO: 5 and LCDR3 comprises or consists of a sequence having at least 80% identity with SEQ ID NO: 6.

Also provided is a polypeptide (such as an antibody or fragment thereof) which binds to LPAR1 comprising a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 15, LCDR1 comprises or consists of a sequence having at least 80% identity with SEQ ID NO: 4, LCDR2 comprises or consists of a sequence having at least 80% identity with SEQ ID NO: 5 and LCDR3 comprises or consists of a sequence having at least 80% identity with SEQ ID NO: 6.

Also provided is a polypeptide (such as an antibody or fragment thereof) which binds to LPAR1 comprising a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 3, LCDR1 comprises or consists of a sequence having at least 80% identity with SEQ ID NO: 4, LCDR2 comprises or consists of a sequence having at least 80% identity with SEQ ID NO: 98 and LCDR3 comprises or consists of a sequence having at least 80% identity with SEQ ID NO: 6.

Also provided is a polypeptide (such as an antibody or fragment thereof) which binds to LPAR1 comprising a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 100, HCDR3 comprises or consists of a sequence having at least 80% identity with SEQ ID NO: 101, LCDR1 comprises or consists of a sequence having at least 80% identity with SEQ ID NO: 4, LCDR2 comprises or consists of a sequence having at least 80% identity with SEQ ID NO: 98 and LCDR3 comprises or consists of a sequence having at least 80% identity with SEQ ID NO: 6.

Also provided is a polypeptide (such as an antibody or fragment thereof) which binds to LPAR1 comprising a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 100, HCDR3 comprises or consists of a sequence having at least 80% identity with SEQ ID NO: 101, LCDR1 comprises or consists of a sequence having at least 80% identity with SEQ ID NO: 103, LCDR2 comprises or consists of a sequence having at least 80% identity with SEQ ID NO: 98 and LCDR3 comprises or consists of a sequence having at least 80% identity with SEQ ID NO: 6.

Also provided is a polypeptide (such as an antibody or fragment thereof) which binds to LPAR1 comprising a VH region comprising or consisting of a sequence having at least 80% identity with SEQ ID NO: 36, 37 or SEQ ID NO: 102 and a VL region comprising or consisting of a sequence having at least 80% identity with SEQ ID NO: 38, 99 or 104.

Also provided is a polypeptide (such as an antibody) which binds to LPAR1 which comprises or consists of a heavy chain comprising or consisting of SEQ ID NO: 58, SEQ ID NO: 60 or SEQ ID NO: 1220, and a light chain comprising or consisting of SEQ ID NO: 59, SEQ ID NO: 61, SEQ ID NO: 1219 or SEQ ID NO: 1221.

Also provided is a construct comprising the polypeptide of the invention.

Also provided is composition comprising the polypeptide or construct of the invention.

Also provided is a pharmaceutical composition comprising the polypeptide or construct of the invention, together with a pharmaceutically acceptable diluent or carrier.

Also provided is the polypeptide, construct or composition of the invention for use as a medicament.

Also provided is the polypeptide, construct or composition of the invention for use in the treatment of an inflammatory disease and/or fibrotic disease.

Also provided is the polypeptide, construct or composition of the invention for use in the treatment of a disease selected from the list consisting of chronic kidney disease, kidney fibrosis, peritoneal fibrosis, liver fibrosis, pulmonary fibrosis, dermal fibrosis, systemic sclerosis and osteoarthritis.

Also provided is a polynucleotide encoding the polypeptide or construct of the invention.

Also provided is an expression vector comprising the polynucleotide sequence of the invention.

Also provided is a cell comprising the polynucleotide sequence or expression vector of the invention.

In certain embodiments, the polypeptides of the invention may be expected to benefit from one or more of the following advantages over the prior art:

(a) binding of functional LPAR1 on the surface of live cells (b) allosteric inhibition of LPAR1

(c) inverse agonism of LPAR1

(d) reduction of Gi/o and/or G13 and/or Gq signalling by the LPAR1

(e) reduction or prevention of LPA-induced or constitutive cAMP signalling (f) reduction or prevention of LPA-induced calcium mobilisation (g) binding to novel epitopes (h) reduced toxicity (i) increased potency (j) increased binding affinity (k) increased half-life (l) reduced dosing (m) binding to the extracellular region of LPAR1

4

Figure 6:
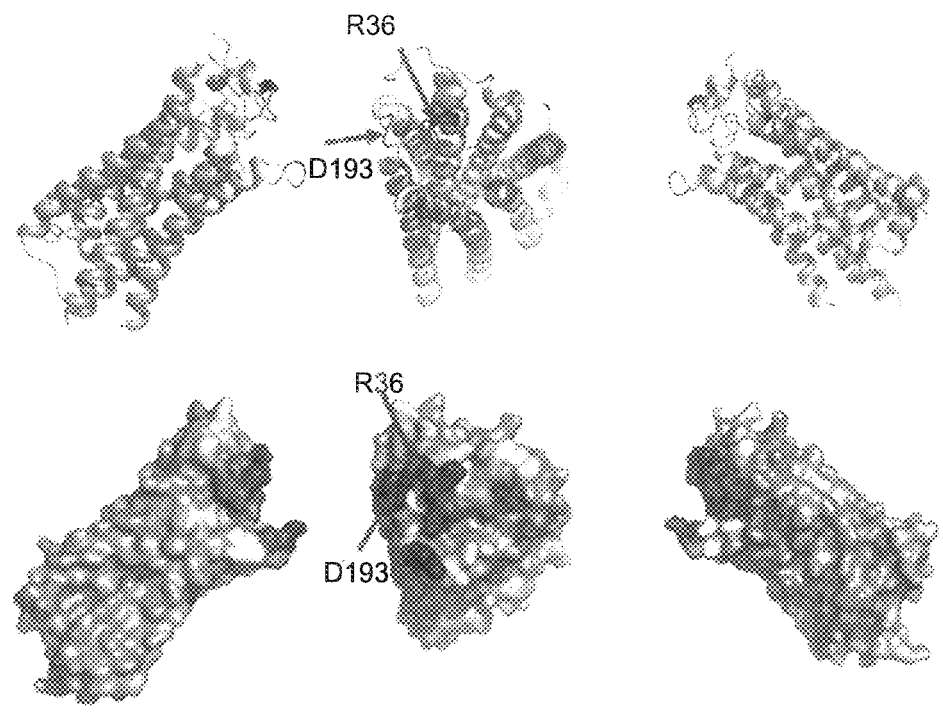

FIG. 2A-D—Antibody 13 expression level compared to an Adalimumab biosimilar, ability to increase cAMP signalling, ability to inhibit calcium signalling and ability to decrease cell proliferation FIG. 3A-C—Epitope prediction for Antibody 7b FIG. 4—Paratope prediction for Antibody 7b FIG. 5—In vitro epitope analysis FIG. 6—Epitope depiction on LPAR1

Figure 8:
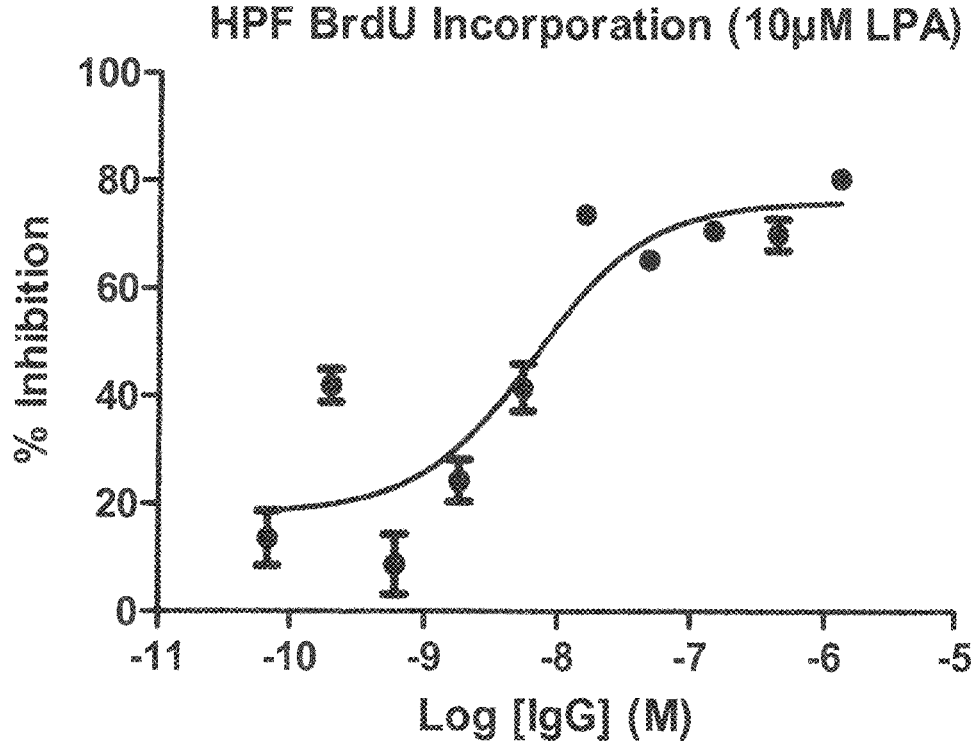
Figure 11:
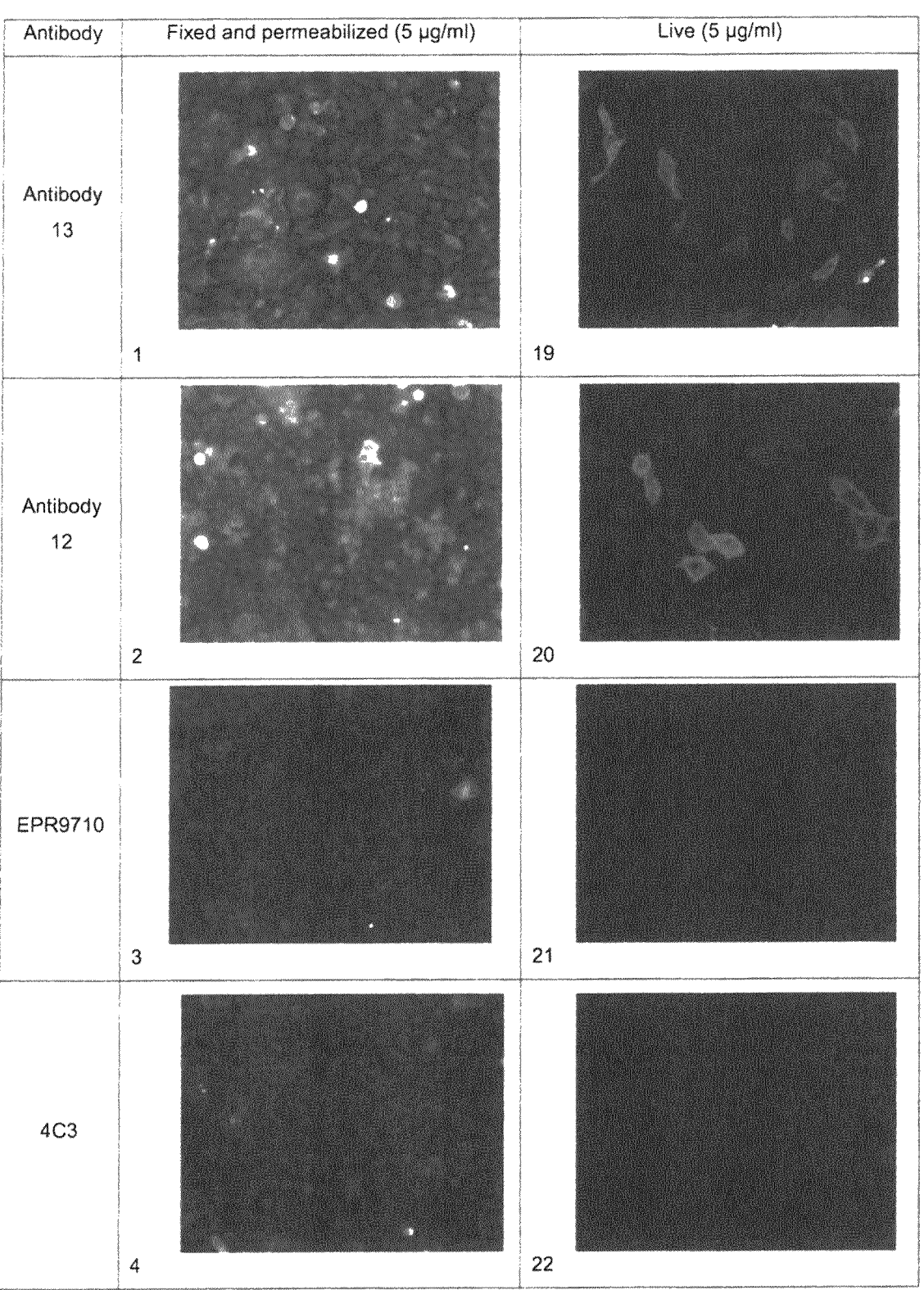
Figure 11:
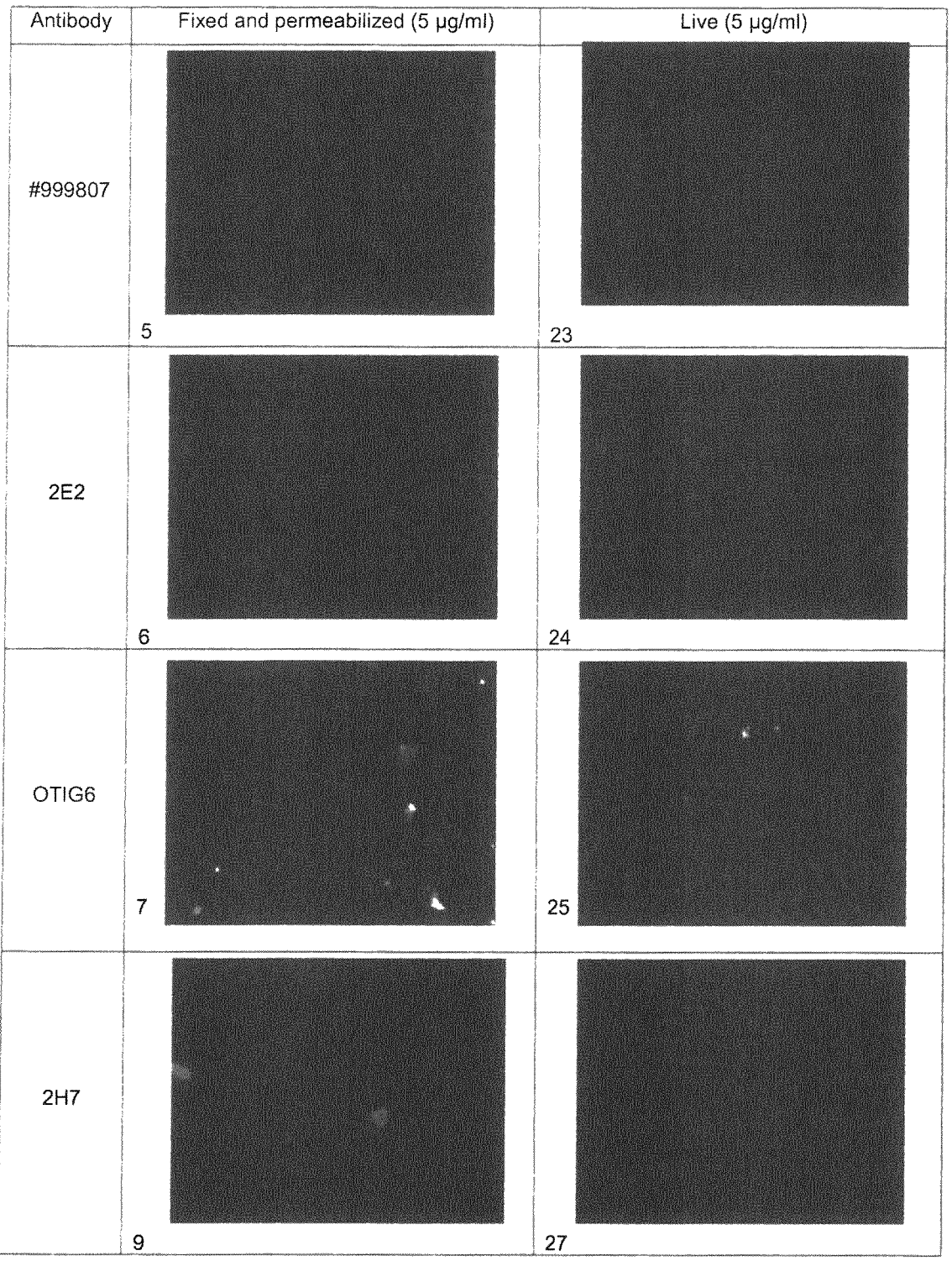
Figure 11:
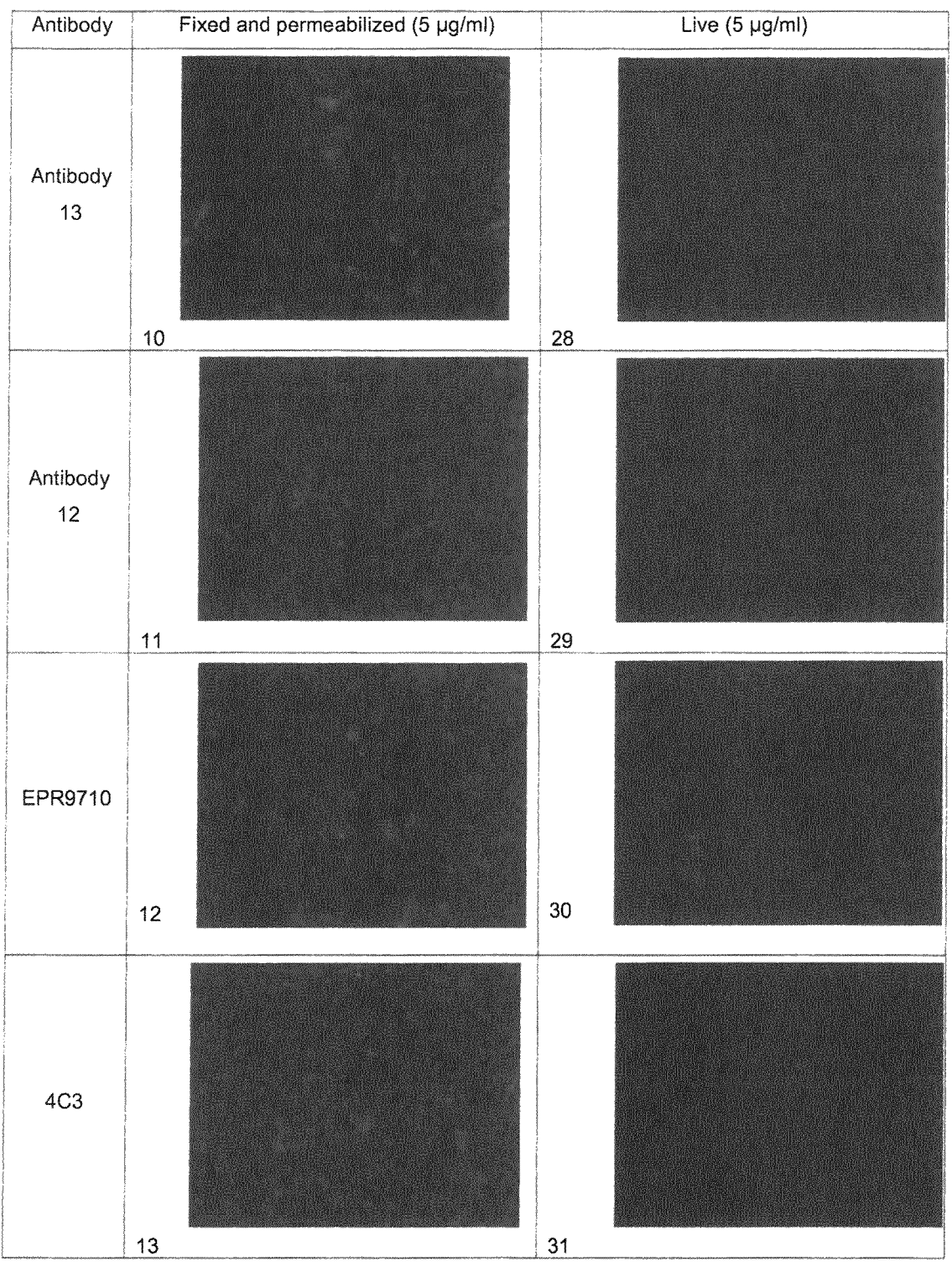
Figure 11:
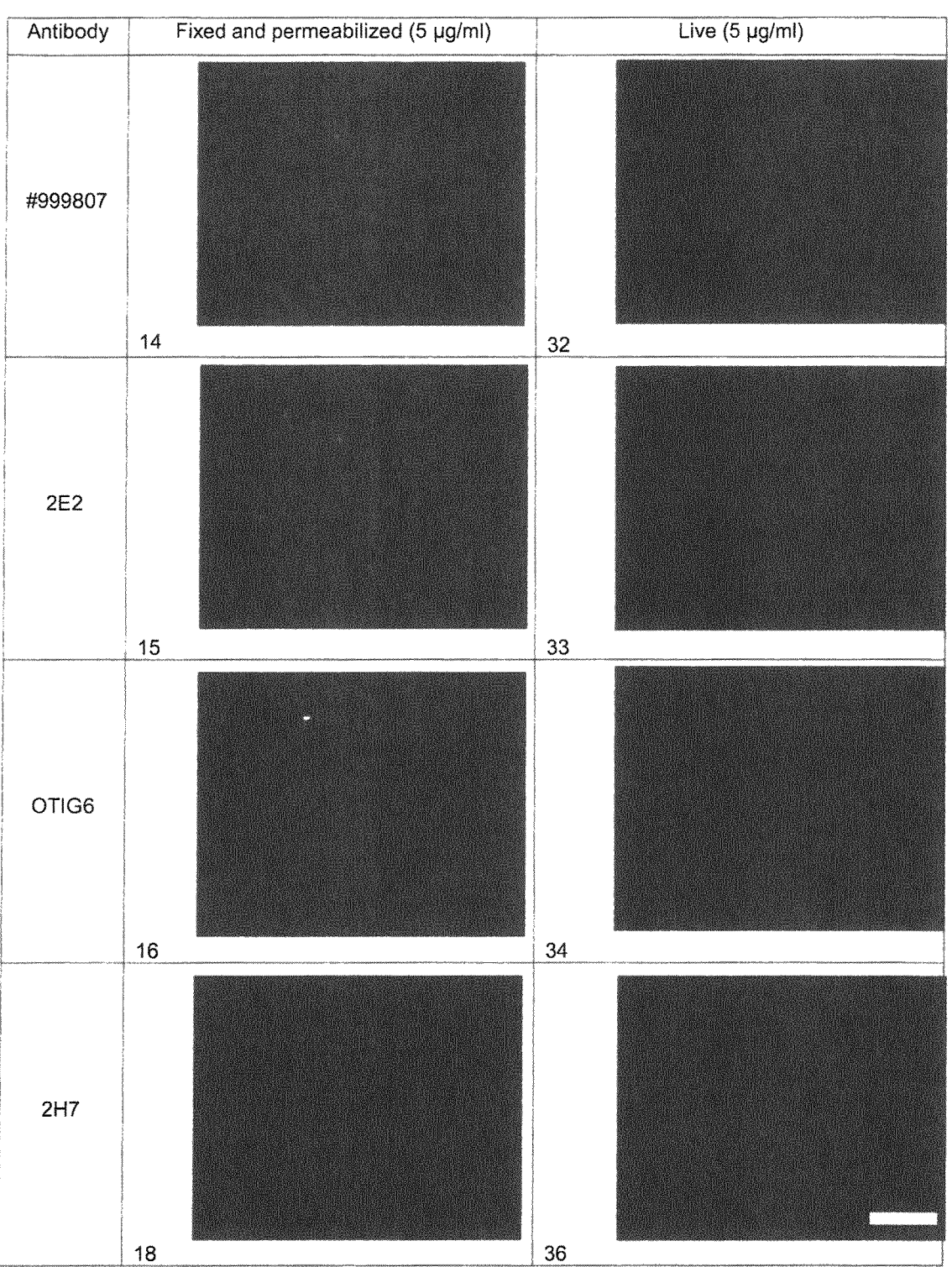

FIG. 7A-D—Antibody 15 expression level compared to a Palivizumab biosimilar, ability to increase cAMP signalling, ability to decrease cell proliferation and ability to bind to huLPAR1-HA cells FIG. 8A-C—Antibody 16 expression level compared to a Palivizumab biosimilar, ability to increase cAMP signalling and ability to decrease cell proliferation FIG. 9A-D—Antibody 17 expression level compared to a Palivizumab biosimilar, ability to increase cAMP signalling, ability to decrease cell proliferation and ability to bind to huLPAR1-HA cells FIG. 10A-D—Antibody 18 expression level compared to a Palivizumab biosimilar, ability to increase cAMP signalling, ability to decrease cell proliferation and ability to bind to huLPAR1-HA cells FIG. 11—CIFAT assay microscopy imaging results for antibodies of the invention and the prior art (5 ug/ml concentration with live cells)

Figure 12:
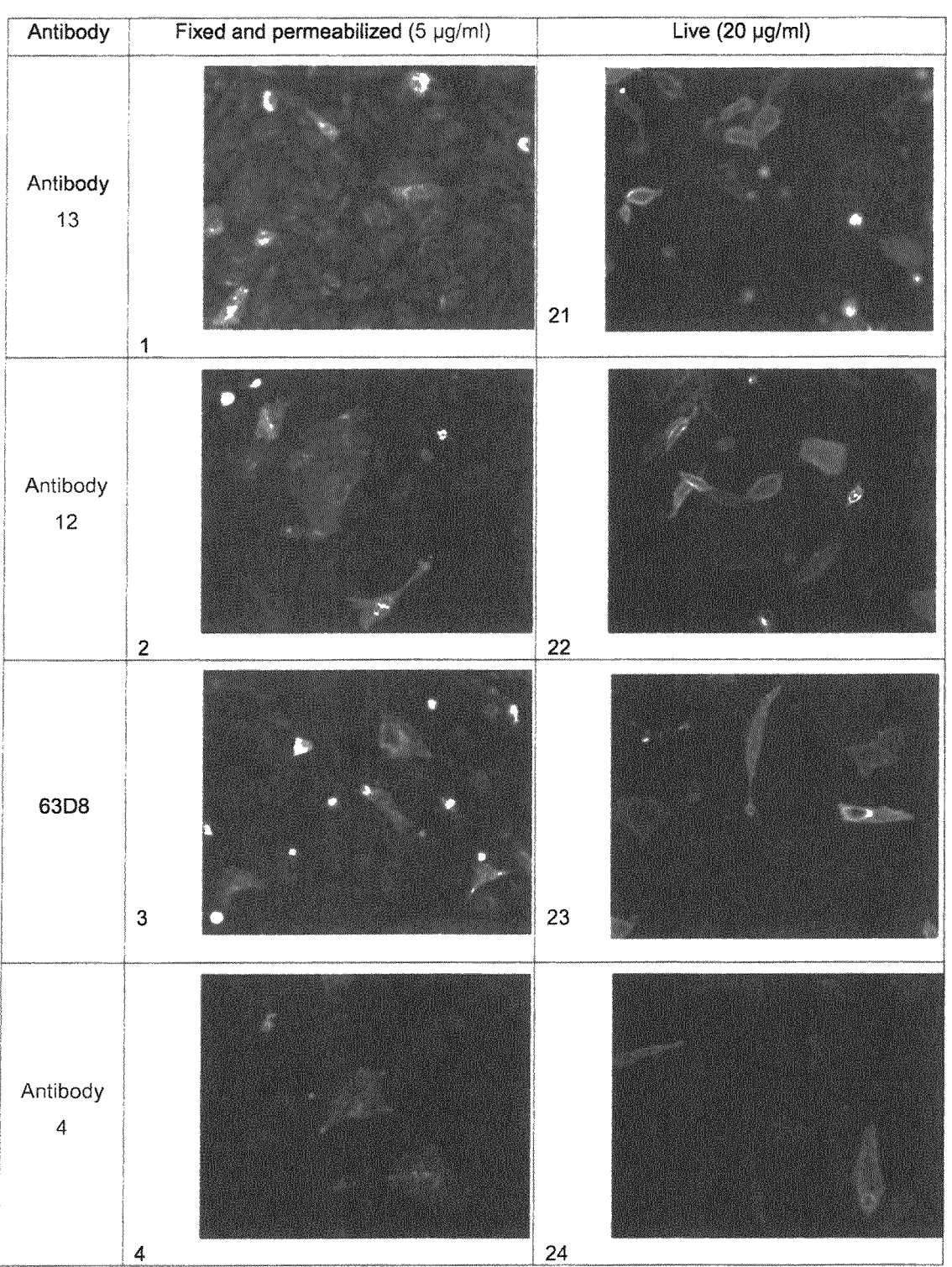
Figure 12:
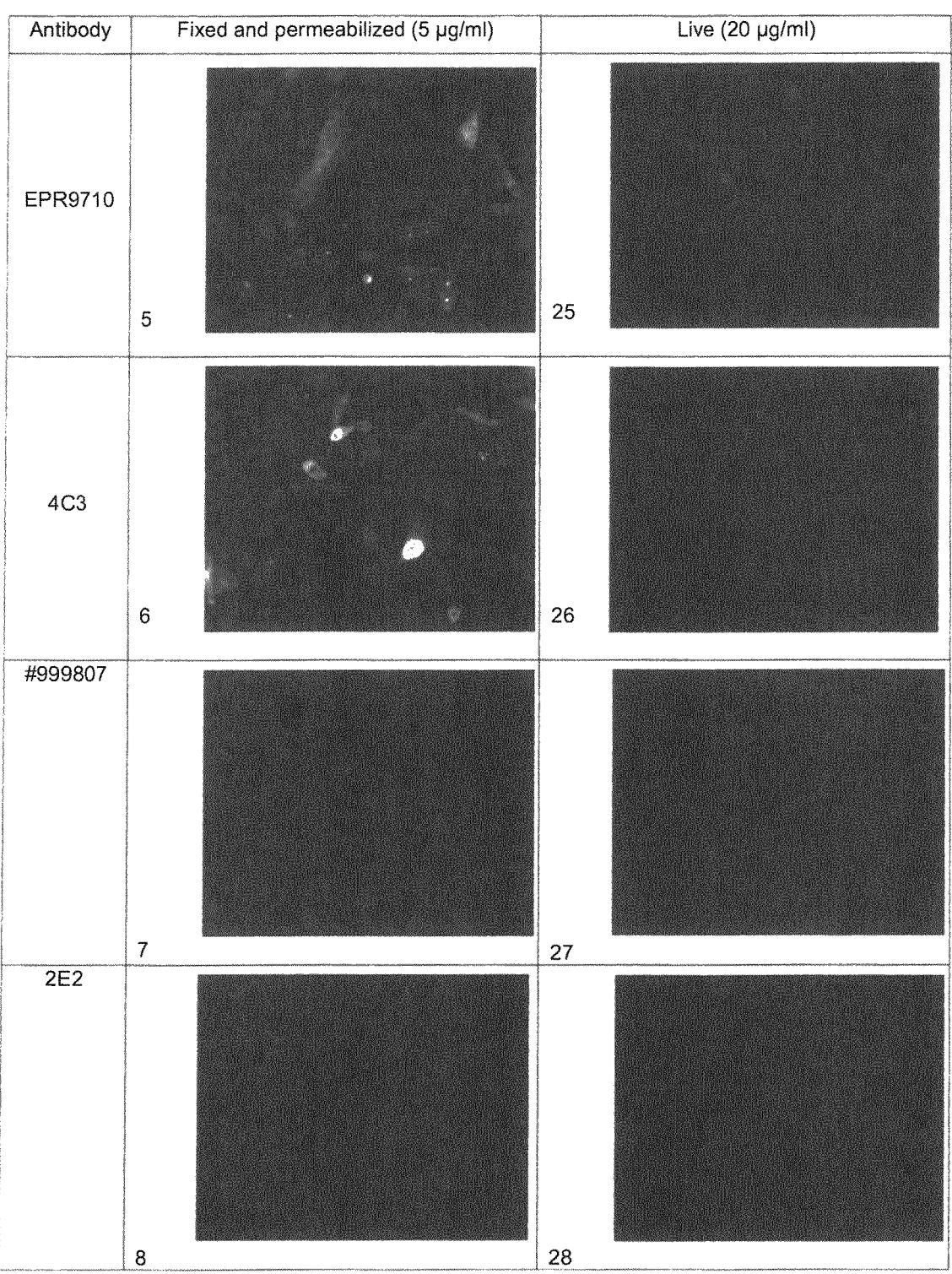
Figure 12:
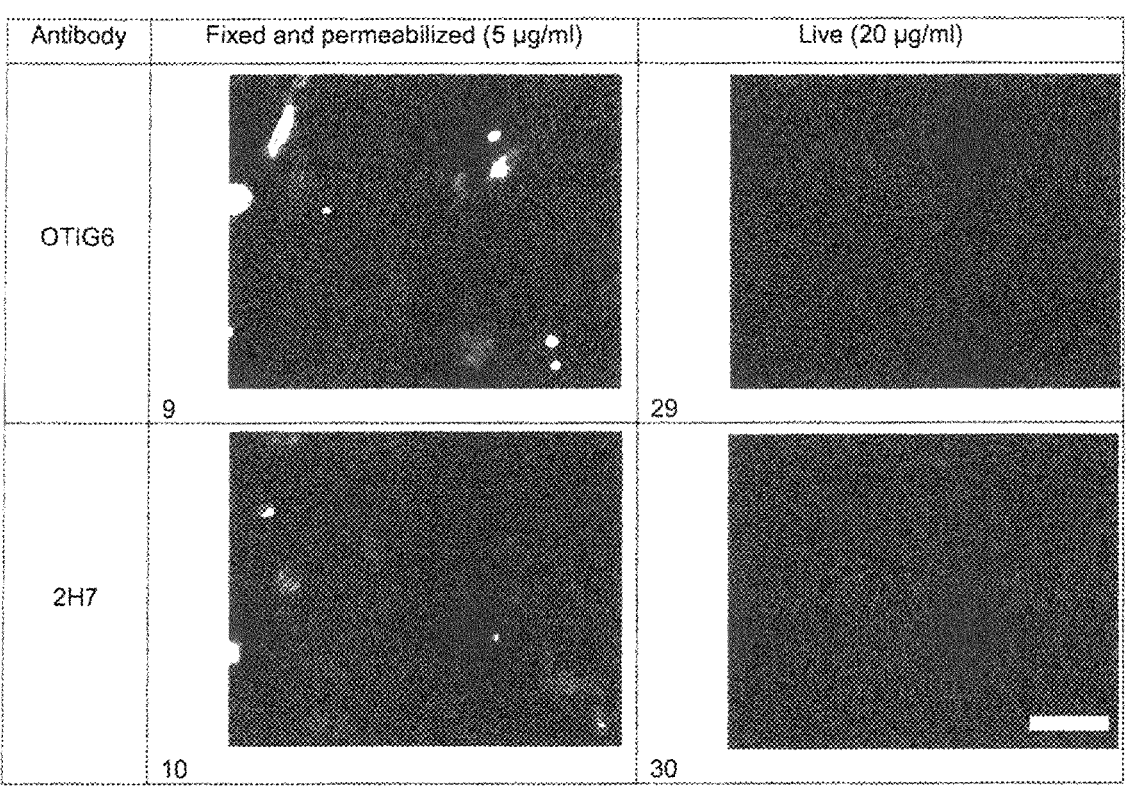
Figure 12:
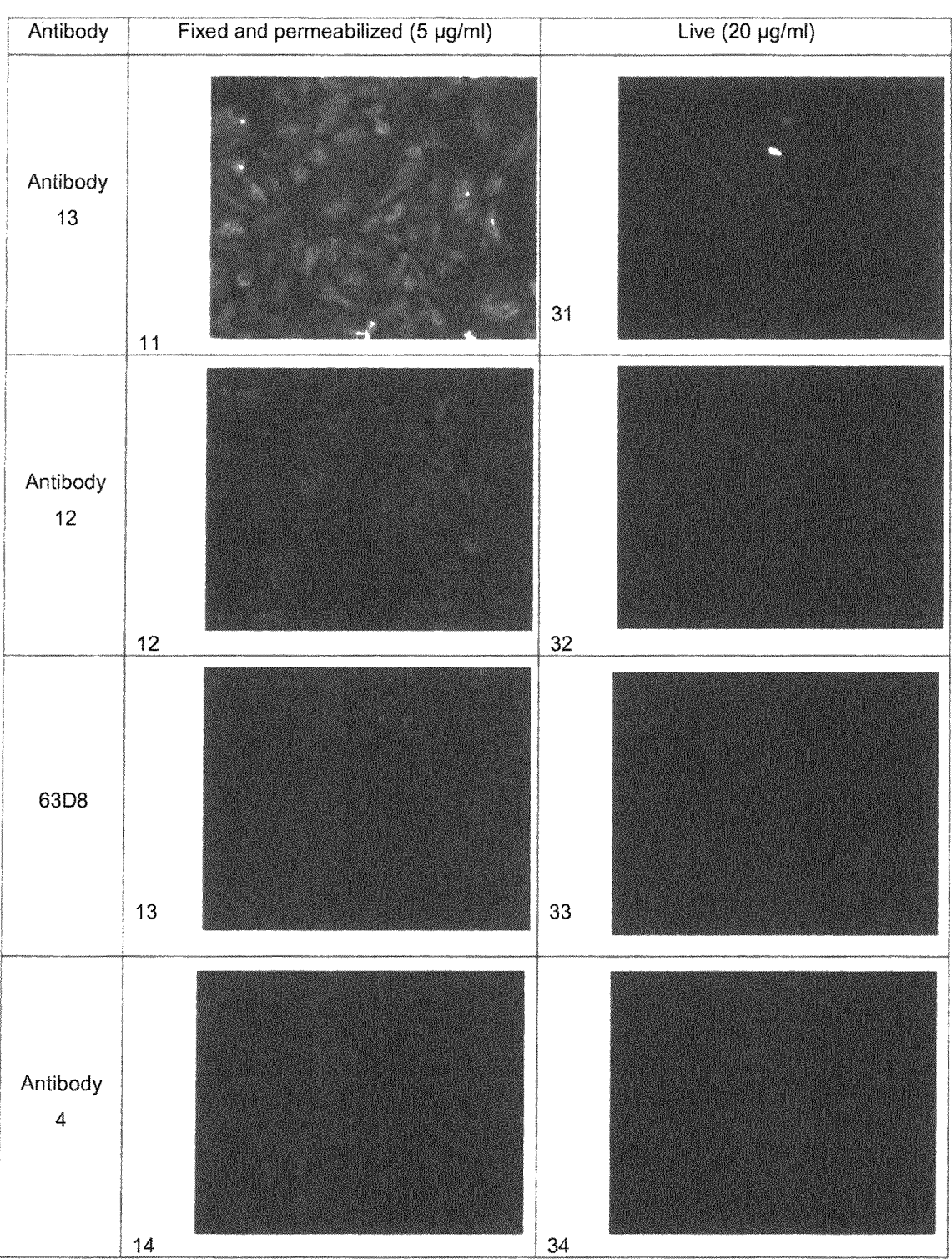
Figure 12:
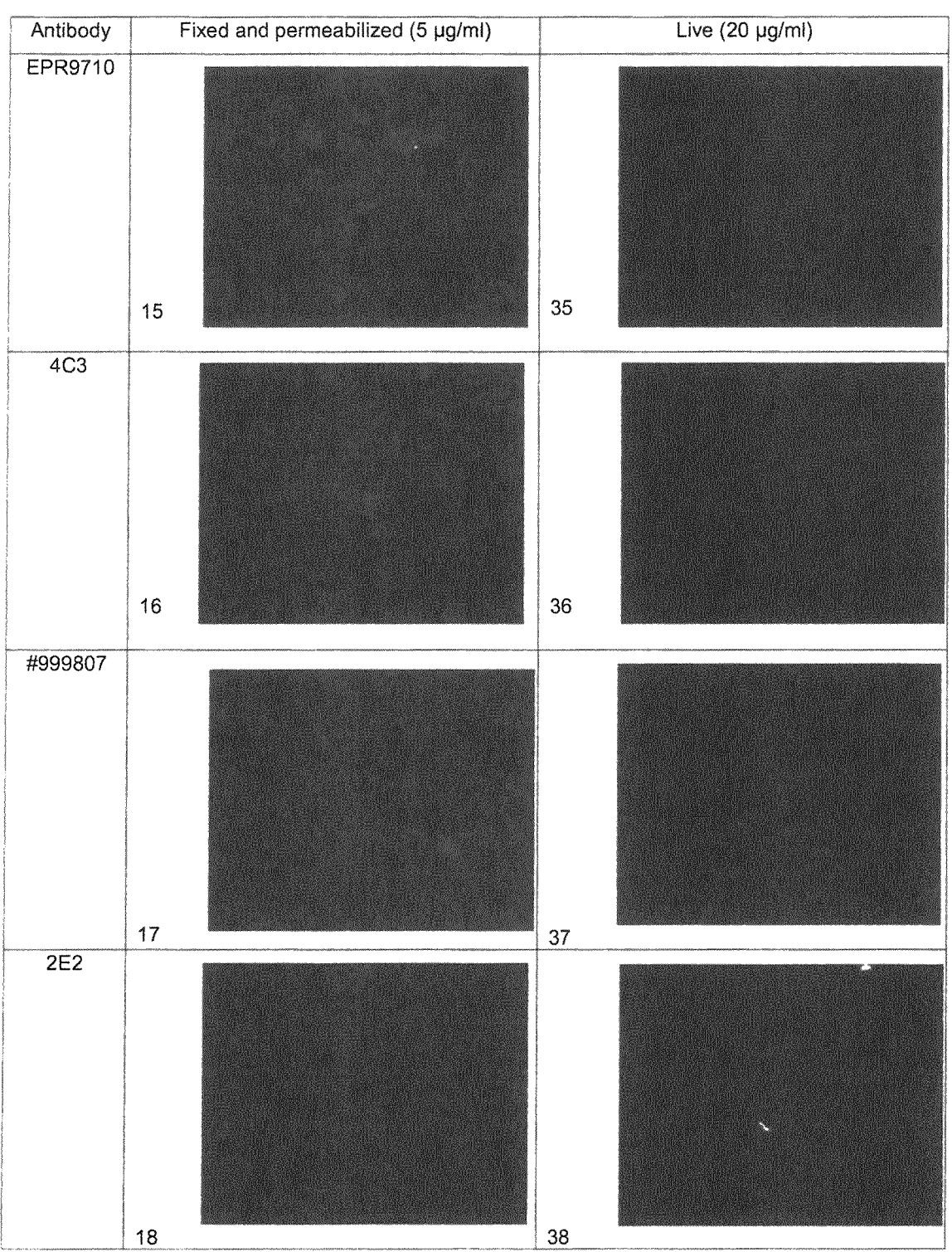
Figure 12:
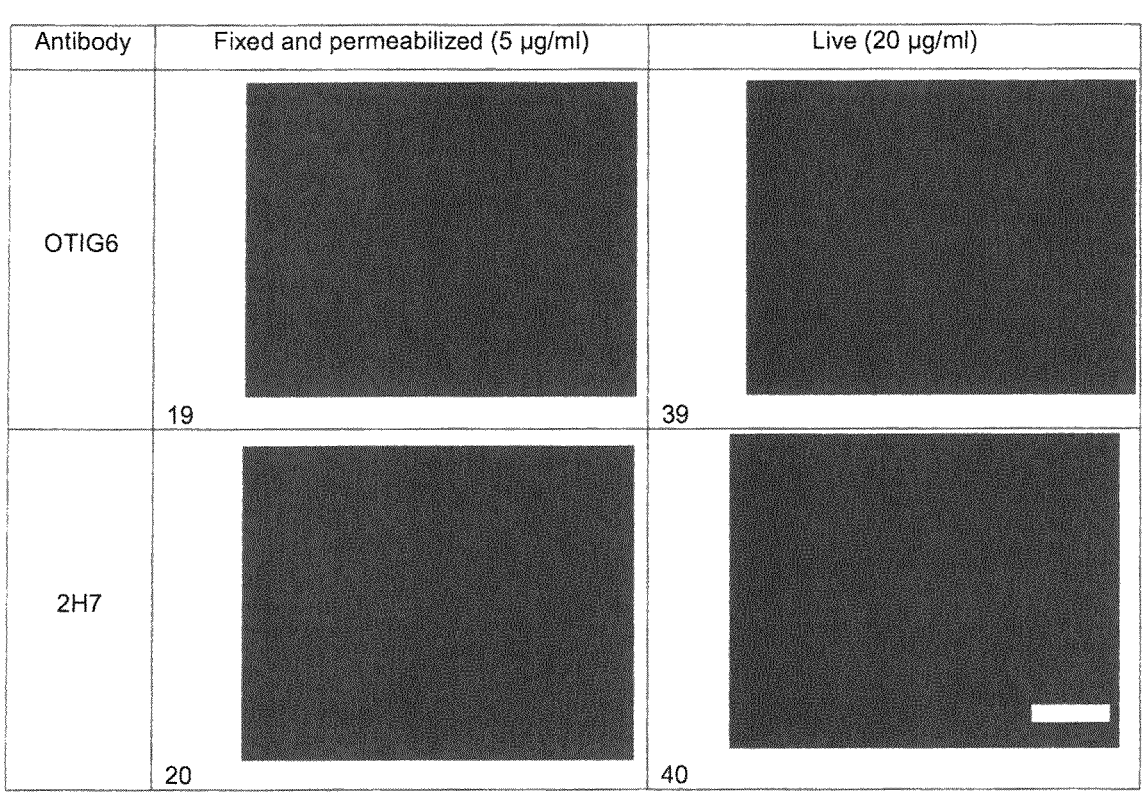

FIG. 12—CIFAT assay microscopy imaging results for antibodies of the invention and the prior art (20 ug/ml concentration with live cells)

FIG. 13A-B—BRET investigation of Antibody 12 compared to small molecule inhibitor of the prior art FIG. 14A-D—Ability of Antibodies 12, 15, 17 and 18 to bind to human, guinea-pig, rabbit and mouse LPAR1

FIG. 15A-D—Ability of Antibodies 12, 15, 17 and 18 to bind to human LPAR1, LPAR2 and LPAR3

FIG. 16A-D—Pharmacokinetics of Antibodies 12, 15, 17 and 18 in rats

FIG. 17A-F—SEC-MALS of Antibodies 12, 13, 15, 16, 17 and 18

FIG. 18A-B—Unilateral ureteral obstruction efficacy analysis in guinea pigs using Antibody 13 and Antibody 17

DESCRIPTION OF THE SEQUENCES

| SEQ ID NO: | Polypeptide Sequence of |
| --- | --- |
| 1 | 12 HCDR1 |
| 2 | 12 HCDR2 |
| 3 | 12 HCDR3 |
| 4 | 12 LCDR1 |
| 5 | 12 LCDR2 |
| 6 | 12 LCDR3 |
| 7 | 02 HCDR1 |
| 8 | 01 HCDR2 |
| 9 | 02 HCDR2 |
| 10 | 04 HCDR2 |
| 11 | 07 HCDR2 |
| 12 | 01 HCDR3 |
| 13 | 02 HCDR3 |
| 14 | 04 HCDR3 |
| 15 | 11 HCDR3 |
| 16 | 01 LCDR1 |
| 17 | 02 LCDR1 |
| 18 | 04 LCDR1 |
| 19 | 01 LCDR2 |
| 20 | 01 LCDR3 |
| 21 | 02 LCDR3 |

SEQ
ID
NO: Polypeptide Sequence of

| 22 | 05 LCDR3 |
| 23 | 1 VH |
| 24 | 1 VL |
| 25 | 2 VH |
| 26 | 2 VL |
| 27 | 3 VH |
| 28 | 3 VL |
| 29 | 4 VH |
| 30 | 4 VL |
| 31 | 5 VL |
| 32 | 6 VL |
| 33 | 7 VH |
| 34 | 7 VL |
| 35 | 9 VH |
| 36 | 12 VH |
| 37 | 11 VH |
| 38 | 12 VL |
| 39 | 11 VL |
| 40 | 12 HFR1 |
| 41 | 12 HFR2 |
| 42 | 12 HFR3 |
| 43 | 12 HFR4 |
| 44 | 12 LFR1 |
| 45 | 12 LFR2 |
| 46 | 12 LFR3 |
| 47 | 12 LFR4 |
| 48 | 11 HFR1 |
| 49 | 11 HFR2 |
| 50 | 11 HFR3 |
| 51 | 11 HFR4 |
| 52 | 11 LFR1 |
| 53 | 11 LFR2 |
| 54 | 11 LFR3 |
| 55 | 11 LFR4 |
| 56 | 12 heavy chain constant region (LALA PS) |
| 57 | 12 light chain constant region |
| 58 | 12 heavy chain |
| 59 | 12 light chain |
| 60 | 11 heavy chain |
| 61 | 11 light chain |
| 62 | full length LPAR1 |
| 63 | an isoform of full length LPAR1 |
| 64 | modified LPAR1 |
| 65 | epitope region 1 |
| 66 | epitope region 2 |
| 67 | epitope region 3 |
| 68 | epitope region 4 |
| 69 | linker |
| 70 | VH formula 1 |
| 71 | VL formula 1 |
| 72 | HCDR1 formula 1 |
| 73 | HCDR1 formula 2 |
| 74 | HCDR1 formula 3 |
| 75 | HCDR1 formula 4 |
| 76 | HCDR2 formula 1 |
| 77 | HCDR2 formula 2 |
| 78 | HCDR2 formula 3 |
| 79 | HCDR2 formula 4 |
| 80 | HCDR3 formula 1 |
| 81 | HCDR3 formula 2 |
| 82 | HCDR3 formula 3 |
| 83 | HCDR3 formula 4 |
| 84 | LCDR1 formula 1 |
| 85 | LCDR1 formula 2 |
| 86 | LCDR1 formula 3 |
| 87 | LCDR1 formula 4 |
| 88 | LCDR2 formula 1 |
| 89 | LCDR2 formula 2 |
| 90 | LCDR2 formula 3 |
| 91 | LCDR2 formula 4 |
| 92 | LCDR3 formula 1 |
| 93 | LCDR3 formula 2 |
| 94 | LCDR3 formula 3 |
| 95 | LCDR3 formula 4 |
| 96 | 14 VH |

SEQ
ID
NO: Polypeptide Sequence of

| 97 | 14 VL |
| 98 | 15 LCDR2 |
| 99 | 15 VL |
| 100 | 17 HCDR2 |
| 101 | 17 HCDR3 |
| 102 | 17 VH |
| 103 | 18 LCDR1 |
| 104 | 18 VL |
| 105 | 169A1 VH |
| 106 | 169A1 VL |
| 107 | 63D8 HCDR1 |
| 108 | 63D8 HCDR2 |
| 109 | 63D8 HCDR3 |
| 110 | 63D8 LCDR1 |
| 111 | 63D8 LCDR2 |
| 112 | 63D8 LCDR3 |
| 113 | 63D8 VH |
| 114 | 63D8 VL |
| 115 | Tgex 207B7 Hu-VL3-germ-IGKV1-33*01 |
| 116 | HuVL4_H90S93_Y87F |
| 117 | HuVL3_H90S93_S1D |
| 118 | HuVL4_H90S93_L54R |
| 119 | 63D8_HuVL2_v2 |
| 120 | 63D8_HuVL1_v2 |
| 121 | 63D8_HuVL3_v2 |
| 122 | 63D8_HuVL4_v2 |
| 123 | TGEX-LC Human Kappa 63D8 |
| 124 | TGEX-HC Human IgG1 repurified 63D8 |
| 125 | Tgex 63D8_HuVH3-sil |
| 126 | Tgex 63D8_HuVH1-sil |
| 127 | Tgex 63D8_HuVH2-sil |
| 128 | Hu-VL3_Q1G55H90S93 |
| 129 | Tgex 63D8_HuVH4-sil (LALA_P331S) |
| 130 | TGEX-HC Human IgG1 207B7 (LPAR1) |
| 131 | TGEX-HC Human IgG1 207B7 germline 207B7169A1 CDRs |
| 132 | TGEX-HC Human IgG1 207B7 germline 207B7 CDRs |
| 133 | TGEX-HC Human IgG1 169A1 |
| 134 | TGEX-HC Human IgG1 207B7 169A1 LCA |
| 135 | TGEX-HC Human IgG1 207B7 germline 169A1 CDRs |
| 136 | TGEX-HC Human IgG1 207B7 germline LCA CDRs |
| 137 | TGEX-HC Human IgG1 207B7 germline |
| 138 | huVH4_D30Q61K97G99 Fab |
| 139 | Tgex 207B7 huVH4_E30K31061K97G99 IgG1 |
| 140 | Tgex 207B7 huVH4_E30Q61A97A99 IgG1 |
| 141 | Tgex huVH4_E30Q61K97G98G99 sil (LALA_P331S) |
| 142 | huVH4_E30Q61K97G99 Fab |
| 143 | Tgex huVH4_E30061R97G98G99 sil (LALA_P331S) |
| 144 | Tgex huVH4_E30Q61-CDRH3-43 sil (LALA_P331S) |
| 145 | huVH4_G30Q61K97G99 Fab |
| 146 | huVH4_K30Q61K97G99 Fab |
| 147 | huVH4_N30Q61K97G99 Fab |
| 148 | huVH4_R30Q61K97G99 Fab |
| 149 | Tgex 207B7 huVH4_S30K60Q61A97A99 IgG1 |
| 150 | TTgex 207B7 huVH4_S30K60Q61K97G99 IgG1 |
| 151 | Tgex 207B7 huVH4_S30K60Q61K62E64A97A99 IgG1 |
| 152 | Tgex 207B7 huVH4_S30K60Q61K62E64K97G99 IgG1 |
| 153 | Tgex 207B7 huVH4_S30Q61A97A99 IgG1 |
| 154 | huVH4_S30Q61K97G99 Fab |
| 155 | Tgex 207B7 huVH4_S30Q61K62E64A97A99 IgG1 |
| 156 | Tgex 207B7 huVH4_S30Q61K62E64K97G99 IgG1 |
| 157 | Tgex 207B7 huVH4_S30Q61K62A97A99 IgG1 |
| 158 | Tgex 207B7 huVH4_S30Q61K62K97G99 IgG1 |

-continued

-continued

| SEQ ID NO: | Polypeptide Sequence of |
|---|---|
| 159 | HuVH4-QRGG_A31 |
| 160 | Tgex 207B7 huVH4_K31 Q61A97A99 IgG1 |
| 161 | Tgex 207B7 huVH4_K31 Q61K97G99 IgG1 |
| 162 | huVH4_R31D52Q61K97G99 IgG |
| 163 | huVH4_R31D53Q61K97G99 IgG |
| 164 | huVH4_R31D54Q61K97G99 IgG |
| 165 | huVH4_R31D56Q61K97G99 IgG |
| 166 | huVH4_R31E56Q61K97G99 IgG |
| 167 | huVH4_R31E58Q61K97G99 IgG |
| 168 | huVH4_R31E58Q61K97G99 IgG |
| 169 | huVH4_R31Q61A62K97G99 IgG |
| 170 | huVH4_R31Q61K97G99 IgG |
| 171 | huVH4_R31T32Q61K97G99 IgG |
| 172 | HuVH4-QRGG_A32 |
| 173 | huVH4_H32Q35Q61A62K97G99 IgG |
| 174 | huVH4_H32Q35Q61K97G99 IgG |
| 175 | huVH4_H32Q61A62K97G99 IgG |
| 176 | huVH4_H32Q61K97G99 IgG |
| 177 | huVH4_R32Q61A62K97G99 IgG |
| 178 | huVH4_R32Q61K97G99 IgG |
| 179 | HuVH4-QRGG_A33N35 |
| 180 | HuVH4-QRGG_A33 |
| 181 | HuVH4-QRGG_A33M34N35 |
| 182 | huVH4-QRGG_A35 |
| 183 | huVH4_E35Q61K97G99 IgG |
| 184 | HuVH4-QRGG_N35 |
| 185 | huVH4_Q35Q61K97G99 IgG |
| 186 | huVH3_E61G97G99G104 |
| 187 | huVH3_E61R97G99G104 |
| 188 | huVH3_E61R97S99G104 |
| 189 | huVH4-QRGG_I48S75 |
| 190 | huVH4-QRGG_I48F91 |
| 191 | huVH4-QRGG_I48 |
| 192 | huVH3_Q61G97G99G104 |
| 193 | huVH3_Q61G97S99G104 |
| 194 | huVH3_Q61R97G99G104 |
| 195 | huVH3_Q61R97S99G104 |
| 196 | huVH4-QRGG_I48L69 |
| 197 | huVH4_D52Q61R97G99 Fab |
| 198 | huVH4_G52Q61R97G99 Fab |
| 199 | Tgex 207B7 huVH4_A52aQ61A97A99 IgG1 |
| 200 | Tgex 207B7 huVH4_D52aQ61A97A99 IgG1 |
| 201 | Tgex 207B7 huVH4_F52aQ61A97A99 IgG1 |
| 202 | Tgex 207B7 huVH4_G52aQ61A97A99IgG1 |
| 203 | Tgex 207B7 huVH4_N52aQ61A97A99 IgG1 |
| 204 | Tgex 207B7 huVH4_A53Q61A97A99 IgG1 |
| 205 | Tgex 207B7 huVH4_D53Q61A97A99 IgG1 |
| 206 | huVH4_D53Q61R97G99 Fab |
| 207 | Tgex 207B7 huVH4_E53Q61A97A99 IgG1 |
| 208 | Tgex 207B7 huVH4_G53Q61A97A99 IgG1 |
| 209 | Tgex 207B7 huVH4_H53Q61A97A99 IgG1 |
| 210 | Tgex 207B7 huVH4_I53061A97A99 IgG1 |
| 211 | Tgex 207B7 huVH4_K53Q61A97A99 IgG1 |
| 212 | huVH4_K53Q61R97G99 Fab |
| 213 | Tgex 207B7 huVH4_L53Q61A97A99 IgG1 |
| 214 | Tgex 207B7 huVH4_N53Q61A97A99 IgG1 |
| 215 | Tgex 207B7 huVH4_Q53Q61A97A99 IgG1 |
| 216 | huVH4_Q53Q61R97G99 Fab |
| 217 | huVH4_D54Q61R97G99 Fab |
| 218 | Tgex 207B7 huVH4_A55Q61A97A99 IgG1 |
| 219 | Tgex 207B7 huVH4_D55Q61A97A99 IgG1 |
| 220 | Tgex huVH4_D55Q61K97G98G99 sil (LALA_P331S) |
| 221 | Tgex huVH4_D55Q61R97G98G99 sil (LALA_P331S) |
| 222 | huVH4_D55Q61R97G99 Fab |
| 223 | Tgex huVH4_D55Q61_CDRH3-43 sil (LALA_P331S) |
| 224 | Tgex 207B7 huVH4_E55Q61A97A99 IgG1 |
| 225 | Tgex huVH4_E55Q61_CDRH3-43 sil (LALA_P331S) |
| 226 | huVH4_D56Q61R97G99 Fab |
| 227 | huVH4_E56Q61R97G99 Fab |
| 228 | Tgex 207B7 huVH4_N56Q61A97A99 IgG1 |
| 229 | Tgex 207B7 huVH4_P57Q61A97A99 IgG1 |
| 230 | huVH4_D58Q61R97G99 Fab |

| SEQ ID NO: | Polypeptide Sequence of |
|---|---|
| 231 | huVH4_E58Q61R97G99 Fab |
| 232 | Tgex 207B7 huVH4_H58Q61-CDRH3-4-1-sil (LALA_P331S) |
| 233 | Tgex 207B7 huVH4_H58Q61-CDRH3-4-5-sil (LALA_P331S) |
| 234 | Tgex 207B7 huVH4_H58Q61Q99ins-sil (LALA_P331S) |
| 235 | Tgex 207B7 huVH4_H58Q61K97G98G99-sil (LALA_P331S) |
| 236 | Tgex 207B7 huVH4_H58Q61K97ins-sil (LALA_P331S) |
| 237 | Tgex 207B7 huVH4_H58Q61K97insQ98ins-sil (LALA_P331S) |
| 238 | Tgex 207B7 huVH4_H58Q61Q97ins-sil (LALA_P331S) |
| 239 | Tgex 207B7 huVH4_H58Q61Q97insK98ins-sil (LALA_P331S) |
| 240 | Tgex 207B7 huVH4_H58Q61R97ins-sil (LALA_P331S) |
| 241 | Tgex 207B7 huVH4_H58Q61-CDRH3-4-18-sil (LALA_P331S) |
| 242 | Tgex 207B7 huVH4_H58Q61-CDRH3-4-20-sil (LALA_P331S) |
| 243 | Tgex 207B7 huVH4_H58Q61-CDRH3-4-21-sil (LALA_P331S) |
| 244 | Tgex 207B7 huVH4_H58Q61-CDRH3-4-24-sil (LALA_P331S) |
| 245 | Tgex 207B7 huVH4_H58Q61-CDRH3-4-26-sil (LALA_P331S) |
| 246 | Tgex 207B7 huVH4_H58Q61CDRH3-7-30-sil (LALA_P331S) |
| 247 | Tgex 207B7 huVH4_H58Q61CDRH3-7-39-sil (LALA_P331S) |
| 248 | Tgex 207B7 huVH4_H58Q61-CDRH3-4-40-sil (LALA_P331S) |
| 249 | Tgex 207B7 huVH4_H58Q61CDRH3-7-41-sil (LALA_P331S) |
| 250 | Tgex 207B7 huVH4_H58Q61-CDRH3-4-46-sil (LALA_P331S) |
| 251 | Tgex 207B7 huVH4_H58Q61-CDRH3-4-60-sil (LALA_P331S) |
| 252 | Tgex 207B7 huVH4_H58Q61CDRH3-7-63-sil (LALA_P331S) |
| 253 | Tgex 207B7 huVH4_H58Q61CDRH3-7-64-sil (LALA_P331S) |
| 254 | Tgex 207B7 huVH4_H58Q61-CDRH3-4-76-sil (LALA_P331S) |
| 255 | Tgex 207B7 huVH4_H58Q61KPA99T-sil (LALA_P331S) |
| 256 | Tgex 207B7 huVH4_H58Q61-CDRH3-43-sil (LALA_P331S) |
| 257 | Tgex 207B7 huVH4_H58Q61-CDRH3-4-80-sil (LALA_P331S) |
| 258 | Tgex 207B7 huVH4_H58Q61CDRH3-7-82-sil (LALA_P331S) |
| 259 | Tgex 207B7 huVH4_H58Q61CDRH3-4-84-sil (LALA_P331S) |
| 260 | Tgex 207B7 huVH4_H58Q61-CDRH3-4-90-sil (LALA_P331S) |
| 261 | Tgex 207B7 huVH4_H58Q61-CDRH3-4-92-sil (LALA_P331S) |
| 262 | Tgex 207B7 huVH4_H58Q61-CDRH3-4-96-sil (LALA_P331S) |
| 263 | Tgex 207B7 huVH4_K60Q61A97A99 IgG1 |
| 264 | Tgex 207B7 huVH4_K60Q61K97G99 IgG1 |
| 265 | Tgex 207B7 huVH4_K60Q61K62A97A99 IgG1 |
| 266 | Tgex 207B7 huVH4_K60Q61K62K97G99 IgG1 |
| 267 | huVH4_A61A97A99G104 |
| 268 | huVH4_A61A97A99S104 |
| 269 | huVH4_A61A97G99G104 |
| 270 | huVH4_A61A97S99G104 |
| 271 | huVH4_A61A97S99S104 |
| 272 | huVH4_A61G97A99G104 |
| 273 | huVH4_A61G97A99S104 |
| 274 | huVH4_A61G97G99G104 |
| 275 | huVH4_A61G97G99S104 |
| 276 | huVH4_A61G97S99G104 |
| 277 | huVH4_A61G97S99S104 |
| 278 | huVH4_A61R97A99G104 |
| 279 | huVH4_A61R97A99S104 |
| 280 | huVH4_A61R97G99G104 |
| 281 | huVH4_A61R97G99S104 |
| 282 | 207B7-HuVH4_D61 |
| 283 | huVH4_E61A97A99G104 |
| 284 | huVH4_E61A97A99S104 |
| 285 | huVH4_E61A97S99G104 |
| 286 | huVH4_E61A97S99S104 |
| 287 | 207B7-HuVH4_D97 |
| 288 | 207B7-HuVH4_E97 |
| 289 | 207B7-HuVH4_F97 |
| 290 | huVH4_E61G97A99G104 |
| 291 | huVH4_E61G97A99S104 |
| 292 | 207B7-HuVH4_D99 |
| 293 | 207B7-HuVH4_E99 |
| 294 | 207B7-HuVH4_F99 |
| 295 | 207B7-HuVH4_G99 |
| 296 | 207B7-HuVH4_H99 |
| 297 | 207B7-HuVH4_I99 |
| 298 | 207B7-HuVH4_K99 |
| 299 | 207B7-HuVH4_L99 |
| 300 | 207B7-HuVH4_M99 |
| 301 | 207B7-HuVH4_N99 |
| 302 | 207B7-HuVH4_P99 |
| 303 | 207B7-HuVH4_Q99 |
| 304 | 207B7-HuVH4_R99 |
| 305 | huVH4_E61G97S99G104 |

-continued

| SEQ ID NO: | Polypeptide Sequence of |
|---|---|
| 306 | huVH4_E61G97S99S104 |
| 307 | 207B7-HuVH4_T99 |
| 308 | 207B7-HuVH4_V99 |
| 309 | 207B7-HuVH4_W99 |
| 310 | 207B7-HuVH4_Y99 |
| 311 | 207B7-HuVH4_H97 |
| 312 | 207B7-HuVH4_I97 |
| 313 | 207B7-HuVH4_K97 |
| 314 | 207B7-HuVH4_L97 |
| 315 | 207B7-HuVH4_M97 |
| 316 | 207B7-HuVH4_N97 |
| 317 | 207B7-HuVH4_P97 |
| 318 | 207B7-HuVH4_Q97 |
| 319 | huVH4_E61R97G99S104 |
| 320 | 207B7-HuVH4_R97 |
| 321 | 207B7-HuVH4_S97 |
| 322 | 207B7-HuVH4_T97 |
| 323 | 207B7-HuVH4_V97 |
| 324 | 207B7-HuVH4_W97 |
| 325 | 207B7-HuVH4_Y97 |
| 326 | 207B7-HuVH4_F61 |
| 327 | huVH4_G61A97A99G104 |
| 328 | huVH4_G61A97A99S104 |
| 329 | huVH4_G61A97S99G104 |
| 330 | huVH4_G61A97S99S104 |
| 331 | huVH4_G61G97A99G104 |
| 332 | huVH4_G61G97A99S104 |
| 333 | huVH4_G61G97G99G104 |
| 334 | huVH4_G61G97S99G104 |
| 335 | huVH4_G61G97S99S104 |
| 336 | huVH4_G61R97A99G104 |
| 337 | huVH4_G61R97G99G104 |
| 338 | 207B7-HuVH4_H61 |
| 339 | 207B7-HuVH4_I61 |
| 340 | 207B7-HuVH4_K61 |
| 341 | 207B7-HuVH4_L61 |
| 342 | 207B7-HuVH4_M61 |
| 343 | 207B7-HuVH4_N61 |
| 344 | 207B7-HuVH4_P61 |
| 345 | huVH4_Q61A62K97G99 IgG |
| 346 | huVH4_Q61E62K97G99 IgG |
| 347 | Tgex 207B7 huVH4_Q61E64A97A99 IgG1 |
| 348 | Tgex huVH4_Q61E64K97G98G99 sil (LALA_P331S) |
| 349 | Tgex 207B7 huVH4_Q61E64K97G99 IgG1 |
| 350 | Tgex 207B7 huVH4_Q61E64R97G98G99 sil (LALA_P331S) |
| 351 | huVH4_Q61E64R97G99 Fab |
| 352 | Tgex huVH4_Q61E64_CDRH3-43 sil (LALA_P331S) |
| 353 | Tgex 207B7 huVH4_Q61K64A97A99 IgG1 |
| 354 | Tgex 207B7 huVH4_Q61K64K97G99 IgG1 |
| 355 | huVH4_Q61K64R97G99 Fab |
| 356 | huVH4_Q61M64R97G99 Fab |
| 357 | Tgex 207B7 huVH4_Q61Q64A97A99 IgG1 |
| 358 | Tgex 207B7 huVH4_Q61Q64R97G99 IgG1 |
| 359 | huVH4_Q61Q64R97G99 Fab |
| 360 | huVH4_Q61R64R97G99 Fab |
| 361 | huVH4-QRGG_S75F91 |
| 362 | Tgex huVH4_Q61S75K97G98G99 sil (LALA_P331S) |
| 363 | Tgex huVH4_Q61S75R97G98G99 sil (LALA_P331S) |
| 364 | huVH4-QRGG_S75 |
| 365 | Tgex huVH4_Q61S75_CDRH3-43 Fab |
| 366 | huVH4-QRGG_F91 |
| 367 | Tgex 207B7 huVH4_Q61-CDRH3-4-1-sil (LALA_P331S) |
| 368 | Tgex 207B7 huVH4_Q61A97A99L100c IgG1 |
| 369 | huVH4_Q61A97A99G104 |
| 370 | Tgex 207B7 huVH4_Q61A99A97D100b IgG1 |
| 371 | Tgex 207B7 huVH4_Q61A99A97E100b IgG1 |
| 372 | Tgex 207B7 huVH4_Q61A97A99ST00b IgG1 |
| 373 | Tgex 207B7 huVH4_Q61A97A99T100b IgG1 |
| 374 | huVH4_Q61A97G99G104 |
| 375 | Tgex 207B7 huVH4_Q61-CDRH3-4-5-sil (LALA_P331S) |
| 376 | huVH4_Q61G97AS9G104 |
| 377 | huVH4_Q61G97A99S104 |
| 378 | huVH4_Q61G97G99G104 |
| 379 | huVH4_Q61G97G99S104 |
| 380 | Tgex 207B7 huVH4_Q61Q99ins-sil (LALA_P331S) |

-continued

| SEQ ID NO: | Polypeptide Sequence of |
|---|---|
| 381 | 207B7-HuVH4_Q61 |
| 382 | Tgex 207B7 huVH4_Q61CDRH3-10 IgG1 |
| 383 | Tgex huVH4_Q61K97G98A99 sil (LALA_P331S) |
| 384 | Tgex 207B7 huVH4_Q61K97G98G99 IgG1 |
| 385 | Tgex 207B7 huVH4_Q61K97G98G99S100b sil (LALA_P331S) |
| 386 | Tgex 207B7 huVH4_Q61K97ins-sil (LALA_P331S) |
| 387 | Tgex 207B7 huVH4_Q61K97insQ98ins-sil (LALA_P331S) |
| 388 | Tgex 207B7 huVH4_Q61K97G99L100c IgG1 |
| 389 | huVH4_Q61K97G99 Fab |
| 390 | Tgex 207B7 huVH4_Q61K97G99D100b IgG1 |
| 391 | Tgex 207B7 huVH4_Q61K97G99E100b IgG1 |
| 392 | Tgex 207B7 huVH4_Q61K97G99S100b IgG1 |
| 393 | Tgex 207B7 huVH4_Q61K97G99T100b IgG1 |
| 394 | huVH4_Q61P97 Fab |
| 395 | Tgex 207B7 huVH4_Q61Q97ins-sil (LALA_P331S) |
| 396 | Tgex 207B7 huVH4_Q61Q97insK98ins-sil (LALA_P331S) |
| 397 | huVH4_Q61Q97G99 Fab |
| 398 | huVH4_Q61Q97 Fab |
| 399 | 207B7-HuVH4_A98 |
| 400 | 207B7-HuVH4_D98 |
| 401 | 207B7-HuVH4_E98 |
| 402 | 207B7-HuVH4_F98 |
| 403 | Tgex huVH4_Q61R97G98A99 sil (LALA_P331S) |
| 404 | Tgex huVH4_Q61R97G98G99 sil (LALA_P331S) |
| 405 | Tgex huVH4_Q61R97G98G99S100b sil (LALA_P331S) |
| 406 | Tgex 207B7 huVH4_Q61R97ins-sil (LALA_P331S) |
| 407 | 207B7-HuVH4_H98 |
| 408 | 207B7-HuVH4_I98 |
| 409 | 207B7 HuVH4_K98 |
| 410 | 207B7-HuVH4_L98 |
| 411 | 207B7-HuVH4_M98 |
| 412 | 207B7-HuVH4_N98 |
| 413 | 207B7-HuVH4_P98 |
| 414 | 207B7-HuVH4_Q98 |
| 415 | 207B7-HuVH4_QRGG-R98 |
| 416 | huVH4_Q61R97A99G104 |
| 417 | huVH4_Q61R97A99S104 |
| 418 | huVH4_Q61R97G99G104 |
| 419 | huVH4_Q61R97G99S104 |
| 420 | huVH4_Q61R97S99G104 |
| 421 | 207B7-HuVH4_T98 |
| 422 | 207B7-HuVH4_V98 |
| 423 | 207B7-HuVH4_W98 |
| 424 | 207B7-HuVH4_Y98 |
| 425 | Tgex 207B7 huVH4_Q61CDRH3-22 |
| 426 | Tgex 207B7 huVH4_Q61-CDRH3-4-18-sil (LALA_P331S) |
| 427 | Tgex 207B7 huVH4_Q61-CDRH3-4-20-sil (LALA_P331S) |
| 428 | Tgex 207B7 huVH4_Q61-CDRH3-4-21-sil (LALA_P331S) |
| 429 | Tgex 207B7 huVH4_Q61-CDRH3-4-24-sil (LALA_P331S) |
| 430 | Tgex 207B7 huVH4_Q61-CDRH3-4-26-sil (LALA_P331S) |
| 431 | Tgex 207B7 huVH4_Q61CDRH3-7-30-sil (LALA_P331S) |
| 432 | Tgex 207B7 huVH4_Q61CDRH3-7-39-sil (LALA_P331S) |
| 433 | Tgex 207B7 huVH4_Q61-CDRH3-4-40-sil (LALA_P331S) |
| 434 | Tgex 207B7 huVH4_Q61CDRH3-7-41-sil (LALA_P331S) |
| 435 | Tgex 207B7 huVH4_Q61-CDRH3-4-46-sil (LALA_P331S) |
| 436 | Tgex 207B7 huVH4_Q61-CDRH3-4-60-sil (LALA_P331S) |
| 437 | Tgex 207B7 huVH4_Q61CDRH3-38 IgG1 |
| 438 | Tgex 207B7 huVH4_Q61CDRH3-38 IgG1 |
| 439 | Tgex 207B7 huVH4_Q61CDRH3-7-63-sil (LALA_P331S) |
| 440 | Tgex 207B7 huVH4_Q61CDRH3-7-64-sil (LALA_P331S) |
| 441 | Tgex 207B7 huVH4_Q61-CDRH3-4-76-sil (LALA_P331S) |
| 442 | Tgex huVH4_Q61K96A97P98T100b sil (LALA_P331S) |
| 443 | Tgex huVH4_Q61K96D97P98T100b sil (LALA_P331S) |
| 444 | Tgex huVH4_Q61K96G98T99 sil (LALA_P331S) |
| 445 | Tgex 207B7 huVH4_Q61_CDRH3-42 IgG1 |
| 446 | Tgex huVH4_Q61K96P98A99T100b sil (LALA_P331S) |
| 447 | Tgex huVH4_Q61K96P98D99T100b sil (LALA_P331S) |
| 448 | Tgex huVH4_Q61K96P98G99T100b sil (LALA_P331S) |
| 449 | Tgex huVH4_Q61K96P98 sil (LALA_P331S) |
| 450 | Tgex huVH4_Q61K96P98D100b sil (LALA_P331S) |
| 451 | Tgex huVH4_Q61K96P98S100b sil (LALA_P331S) |
| 452 | Tgex 207B7 huVH4_Q61-CDRH3-43 IgG1 |
| 453 | Tgex 207B7 huVH4_Q61-CDRH3-44 IgG1 |
| 454 | Tgex 207B7 huVH4_Q61K96 IgG1 |
| 455 | Tgex huVH4_Q61K96T100b sil (LALA_P331S) |

| SEQ ID NO: | Polypeptide Sequence of |
|---|---|
| 456 | Tgex huVH4_Q61_CDRH3-46 sil (LALA_P331S) |
| 457 | Tgex huVH4_Q61K96S97P98T100b sil (LALA_P331S) |
| 458 | Tgex 207B7 huVH4_Q61-CDRH3-4-80-sil (LALA_P331S) |
| 459 | Tgex 207B7 huVH4_Q61CDRH3-7-82-sil (LALA_P331S) |
| 460 | Tgex 207B7 huVH4_Q61-CDRH3-4-84-sil (LALA_P331S) |
| 461 | huVH4_Q61Q96 Fab |
| 462 | huVH4_Q61Q96P97A99 Fab |
| 463 | huVH4_Q61Q96P97G99 Fab |
| 464 | huVH4_Q61Q96P97 Fab |
| 465 | Tgex huVH4_Q61_CDRH3-58 sil (LALA_P331S) |
| 466 | Tgex HuVH4_Q61R96P98T100b sil (LALA_P331S) |
| 467 | Tgex huVH4_Q61R96L97 sil (LALA_P331S) |
| 468 | huVH4_Q61S96A97A99 Fab |
| 469 | huVH4_Q61S96G99 Fab |
| 470 | huVH4_Q61S96 Fab |
| 471 | Tgex 207B7 huVH4_Q61-CDRH3-4-90-sil (LALA_P331S) |
| 472 | Tgex 207B7 huVH4_Q61-CDRH3-4-92-sil (LALA_P331S) |
| 473 | Tgex 207B7 huVH4_Q61-CDRH3-4-96-sil (LALA_P331S) |
| 474 | Tgex huVH4_Q61T73K97G98G99 sil (LALA_P331S) |
| 475 | Tgex huVH4_Q61T73R97G98G99 sil (LALA_P331S) |
| 476 | Tgex huVH4_Q61T73_CDRH3-43 sil (LALA_P331S) |
| 477 | Tgex huVH4_Q61L71K97G98G99 sil (LALA_P331S) |
| 478 | Tgex huVH4_Q61L71R97G98G99 sil (LALA_P331S) |
| 479 | Tgex huVH4_Q61L71_CDRH3-43 sil (LALA_P331S) |
| 480 | huVH4-QRGG_L69S75 |
| 481 | huVH4-QRGG_L69F91 |
| 482 | huVH4-QRGG_L69 |
| 483 | Tgex 207B7 huVH4_Q61K62E64A97A99 IgG1 |
| 484 | Tgex 207B7 huVH4_Q61K62E64K97G99 IgG1 |
| 485 | huVH4_Q61K62E64R97G99 Fab |
| 486 | Tgex 207B7 huVH4_Q61K62K64K97G99 IgG1 |
| 487 | Tgex 207B7 huVH4_Q61K62Q64K97G99 IgG1 |
| 488 | Tgex 207B7 huVH4_Q61K62A97A99 IgG1 |
| 489 | Tgex 207B7 huVH4_Q61K62K97G99 IgG |
| 490 | huVH4_Q61W62K97G99 IgG |
| 491 | 207B7-HuVH4_R61 |
| 492 | 207B7-HuVH4_S61 |
| 493 | 207B7-HuVH4_T61 |
| 494 | 207B7-HuVH4_V61 |
| 495 | 207B7-HuVH4_W61 |
| 496 | 207B7 HuVH4_Y61 |
| 497 | Tgex 207B7 huVH4_S58Q61-CDRH3-4-1-sil (LALA_P331S) |
| 498 | Tgex 207B7 huVH4_S58Q61-CDRH3-4-5-sil (LALA_P331S) |
| 499 | Tgex 207B7 huVH4_S58Q61Q99ins-sil (LALA_P331S) |
| 500 | Tgex 207B7 huVH4_S58Q61K97G98G99-sil (LALA_P331S) |
| 501 | Tgex 207B7 huVH4_S58Q61K97ins-sil (LALA_P331S) |
| 502 | Tgex 207B7 huVH4_S58Q61K97insQ98ins-sil (LALA_P331S) |
| 503 | Tgex 207B7 huVH4_S58Q61Q97ins-sil (LALA_P331S) |
| 504 | Tgex 207B7 huVH4_S58Q61Q97insK98ins-sil (LALA_P331S) |
| 505 | Tgex 207B7 huVH4_S58Q61R97ins-sil (LALA_P331S) |
| 506 | Tgex 207B7 huVH4_S58Q61-CDRH3-4-18-sil (LALA_P331S) |
| 507 | Tgex 207B7 huVH4_S58Q61-CDRH3-4-20-sil (LALA_P331S) |
| 508 | Tgex 207B7 huVH4_S58Q61-CDRH3-4-21-sil (LALA_P331S) |
| 509 | Tgex 207B7 huVH4_S58Q61-CDRH3-4-24-sil (LALA_P331S) |
| 510 | Tgex 207B7 huVH4_S58Q61-CDRH3-4-26-sil (LALA_P331S) |
| 511 | Tgex 207B7 huVH4_S58Q61CDRH3-7-30-sil (LALA_P331S) |
| 512 | Tgex 207B7 huVH4_S58Q61CDRH3-7-39-sil (LALA_P331S) |
| 513 | Tgex 207B7 huVH4_S58Q61-CDRH3-4-40-sil (LALA_P331S) |
| 514 | Tgex 207B7 huVH4_S58Q61CDRH3-7-41-sil (LALA_P331S) |
| 515 | Tgex 207B7 huVH4_S58Q61-CDRH3-4-46-sil (LALA_P331S) |
| 516 | Tgex 207B7 huVH4_S58Q61-CDRH3-4-60-sil (LALA_P331S) |
| 517 | Tgex 207B7 huVH4_S58Q61CDRH3-7-63-sil (LALA_P331S) |
| 518 | Tgex 207B7 huVH4_S58Q61CDRH3-7-64-sil (LALA_P331S) |
| 519 | Tgex 207B7 huVH4_S58Q61-CDRH3-4-76-sil (LALA_P331S) |
| 520 | Tgex 207B7 huVH4_S58Q61KPA99T-sil (LALA_P331S) |
| 521 | Tgex 207B7 huVH4_S58Q61-CDRH3-43-sil (LALA_P331S) |
| 522 | Tgex 207B7 huVH4_S58Q61-CDRH3-4-80-sil (LALA_P331S) |
| 523 | Tgex 207B7 huVH4_S58Q61CDRH3-7-82-sil (LALA_P331S) |
| 524 | Tgex 207B7 huVH4_S58Q61-CDRH3-4-84-sil (LALA_P331S) |
| 525 | Tgex 207B7 huVH4_S58Q61-CDRH3-4-90-sil (LALA_P331S) |
| 526 | Tgex 207B7 huVH4_S58Q61-CDRH3-4-92-sil (LALA_P331S) |
| 527 | Tgex 207B7 huVH4_S58Q61-CDRH3-4-96-sil (LALA_P331S) |
| 528 | Tgex 207B7 huVH4_T58Q61A97A99 IgG1 |
| 529 | Tgex 207B7 huVH4_N55Q61A97A99 IgG1 |
| 530 | Tgex 207B7 huVH4_R55Q61A97A99 IgG1 |

| SEQ ID NO: | Polypeptide Sequence of |
|---|---|
| 531 | Tgex 207B7 huVH4_S55Q61A97A99 IgG1 |
| 532 | Tgex huVH4_S55Q61K97G98G99 sil (LALA_P331S) |
| 533 | Tgex huVH4_S55Q61R97G98G99 sil (LALA_P331S) |
| 534 | Tgex huVH4_S55Q61_CDRH3-43 sil (LALA_P331S) |
| 535 | Tgex 207B7 huVH4_T55Q61A97A99 IgG1 |
| 536 | Tgex huVH4_T55Q61_CDRH3-43 sil (LALA_P331S) |
| 537 | Tgex 207B7 huVH4_W55Q61A97A99 IgG1 |
| 538 | Tgex 207B7 huVH4_Y55Q61A97A99 IgG1 |
| 539 | Tgex 207B7 huVH4_T54Q61A97A99 IgG1 |
| 540 | Tgex 207B7 huVH4_S53Q61A97A99 IgG1 |
| 541 | Tgex 207B7 huVH4_T53Q61A97A99 IgG1 |
| 542 | Tgex 207B7 huVH4_W53Q61A97A99 IgG1 |
| 543 | huVH4_W53Q61R97G99 Fab |
| 544 | Tgex 207B7 huVH4_Y53Q61A97A99 IgG1 |
| 545 | Tgex 207B7 huVH4_Q52aQ61A97A99 IgG1 |
| 546 | Tgex 207B7 huVH4_S52aQ61A97A99 IgG1 |
| 547 | Tgex 207B7 huVH4_T52aQ61A97A99 IgG1 |
| 548 | Tgex 207B7 huVH4_W52aQ61A97A99 IgG1 |
| 549 | Tgex 207B7 huVH4_Y52aQ61A97A99 IgG1 |
| 550 | huVH4_N52Q61R97G99 Fab |
| 551 | Tgex 207B7 huVH4_Q52H58Q61-CDRH3-4-1-sil (LALA_P331S) |
| 552 | Tgex 207B7 huVH4_Q52H58Q61-CDRH3-4-5-sil (LALA_P331S) |
| 553 | Tgex 207B7 huVH4_Q52H58Q61Q99ins-sil (LALA_P331S) |
| 554 | Tgex 207B7 huVH4_Q52H58Q61K97G98G99-sil (LALA_P331S) |
| 555 | Tgex 207B7 huVH4_Q52H58Q61K97ins-sil (LALA_P331S) |
| 556 | Tgex 207B7 huVH4_Q52H58Q61K97insQ98ins-sil (LALA_P331S) |
| 557 | Tgex 207B7 huVH4_Q52H58Q61Q97ins-sil (LALA_P331S) |
| 558 | Tgex 207B7 huVH4_Q52H58Q61Q97insK98ins-sil (LALA_P331S) |
| 559 | Tgex 207B7 huVH4_Q52H58Q61R97ins-sil (LALA_P331S) |
| 560 | Tgex 207B7 huVH4_Q52H58Q61-CDRH3-4-18-sil (LALA_P331S) |
| 561 | Tgex 207B7 huVH4_Q52H58Q61-CDRH3-4-20-sil (LALA_P331S) |
| 562 | Tgex 207B7 huVH4_Q52H58Q61-CDRH3-4-21-sil (LALA_P331S) |
| 563 | Tgex 207B7 huVH4_Q52H58Q61-CDRH3-4-24-sil (LALA_P331S) |
| 564 | Tgex 207B7 huVH4_Q52H58Q61-CDRH3-4-26-sil (LALA_P331S) |
| 565 | Tgex 207B7 huVH4_Q52H58Q61CDRH3-7-30-sil (LALA_P331S) |
| 566 | Tgex 207B7 huVH4_Q52H58Q61CDRH3-7-39-sil (LALA_P331S) |
| 567 | Tgex 207B7 huVH4_Q52H58Q61-CDRH3-4-40-sil (LALA_P331S) |
| 568 | Tgex 207B7 huVH4_Q52H58Q61CDRH3-7-41-sil (LALA_P331S) |
| 569 | Tgex 207B7 huVH4_Q52H58Q61-CDRH3-4-46-sil (LALA_P331S) |
| 570 | Tgex 207B7 huVH4_Q52H58Q61-CDRH3-4-60-sil (LALA_P331S) |
| 571 | Tgex 207B7 huVH4_Q52H58Q61CDRH3-7-63-sil (LALA_P331S) |
| 572 | Tgex 207B7 huVH4_Q52H58Q61CDRH3-7-64-sil (LALA_P331S) |
| 573 | Tgex 207B7 huVH4_Q52H58Q61-CDRH3-4-76-sil (LALA_P331S) |
| 574 | Tgex 207B7 huVH4_Q52H58Q61KPA99T-sil (LALA_P331S) |
| 575 | Tgex 207B7 huVH4_Q52H58Q61-CDRH3-43-sil (LALA_P331S) |
| 576 | Tgex 207B7 huVH4_Q52H58Q61-CDRH3-4-80-sil (LALA_P331S) |
| 577 | Tgex 207B7 huVH4_Q52H58Q61CDRH3-7-82-sil (LALA_P331S) |
| 578 | Tgex 207B7 huVH4_Q52H58Q61-CDRH3-4-84-sil (LALA_P331S) |
| 579 | Tgex 207B7 huVH4_Q52H58Q61-CDRH3-4-90-sil (LALA_P331S) |
| 580 | Tgex 207B7 huVH4_Q52H58Q61-CDRH3-4-92-sil (LALA_P331S) |
| 581 | Tgex 207B7 huVH4_Q52H58Q61-CDRH3-4-96-sil (LALA_P331S) |
| 582 | Tgex 207B7 huVH4_Q52Q61-CDRH3-4-1-sil (LALA_P331S) |
| 583 | Tgex 207B7 huVH4_Q52Q61-CDRH3-4-5-sil (LALA K331S) |
| 584 | Tgex 207B7 huVH4_Q52Q61Q99ins-1 sil (LALA_P331S) |
| 585 | Tgex 207B7 huVH4_Q52Q61K97G98G99-sil (LALA_P331S) |
| 586 | Tgex 207B7 huVH4_Q52Q61K97ins-sil (LALA_P331S) |
| 587 | Tgex 207B7 huVH4_Q52Q61K97insQ98ins-sil (LALA P33lS |
| 588 | Tgex 207B7 huVH4_Q52Q61Q97ins-sil (LALA_P331S) |
| 589 | Tgex 207B7 huVH4_Q52Q61Q97insK98ins-sil (LALAP331S) |
| 590 | Tgex 207B7 huVH4_Q52Q61R97ins-sil (LALA_P331S) |
| 591 | Tgex 207B7 huVH4_Q52Q61-CDRH3-4-18-sil (LALA_P331S) |
| 592 | Tgex 207B7 huVH4_Q52Q61-CDRH3-4-20-sil (LALA_P331S) |
| 593 | Tgex 207B7 huVH4_Q52Q61-CDRH3-4-21-sil (LALA_P331S) |
| 594 | Tgex 207B7 huVH4_Q52Q61-CDRH3-4-24-sil (LALA_P331S) |
| 595 | Tgex 207B7 huVH4_Q52Q61-CDRH3-4-26-sil (LALA_P331S) |
| 596 | Tgex 207B7 huVH4_Q52Q61CDRH3-7-30-sil (LALA_P331S) |
| 597 | Tgex 207B7 huVH4_Q52Q61CDRH3-7-39-sil (LALA_P331S) |
| 598 | Tgex 207B7 huVH4_Q52Q61-CDRH3-4-40-sil (LALA_P331S) |
| 599 | Tgex 207B7 huVH4_Q52Q61CDRH3-7-41-sil (LALA_P331S) |
| 600 | Tgex 207B7 huVH4_Q52Q61-CDRH3-4-46-sil (LALA_P331S) |
| 601 | Tgex 207B7 huVH4_Q52Q61-CDRH3-4-60-sil (LALA_P331S) |
| 602 | Tgex 207B7 huVH4_Q52Q61CDRH3-7-63-sil (LALA_P331S) |
| 603 | Tgex 207B7 huVH4_Q52Q61CDRH3-7-64-sil (LALA_P331S) |
| 604 | Tgex 207B7 huVH4_Q52Q61-CDRH3-4-76-sil (LALA_P331S) |
| 605 | Tgex 207B7 huVH4_Q52Q61KPA99T-sil (LALA_P331S) |

-continued

| SEQ ID NO: | Polypeptide Sequence of |
|---|---|
| 606 | Tgex 207B7 huVH4_Q52Q61-CDRH3-43-sil (LALA_P331S) |
| 607 | Tgex 207B7 huVH4_Q52Q61-CDRH3-4-80-sil (LALA_P331S) |
| 608 | Tgex 207B7 huVH4_Q52Q61CDRH3-7-82-sil (LALA_P331S) |
| 609 | Tgex 207B7 huVH4_Q52Q61-CDRH3-4-84-sil (LALA_P331S) |
| 610 | Tgex 207B7 huVH4_Q52Q61-CDRH3-4-90-sil (LALA_P331S) |
| 611 | Tgex 207B7 huVH4_Q52Q61-CDRH3-4-92-sil (LALA_P331S) |
| 612 | Tgex 207B7 huVH4_Q52Q61-CDRH3-4-96-sil (LALA_P331S) |
| 613 | Tgex 207B7 huVH4_Q52S58Q61-CDRH3-4-1-sil (LALA_P331S) |
| 614 | Tgex 207B7 huVH4_Q52S58Q61-CDRH3-4-5-sil (LALA_P331S) |
| 615 | Tgex 207B7 huVH4_Q52S58Q61Q99ins-sil (LALA_P331S) |
| 616 | Tgex 207B7 huVH4_Q52S58Q61K97G98G99-sil (LALA_P331S) |
| 617 | Tgex 207B7 huVH4_Q52S58Q61K97ins-sil (LALA_P331S) |
| 618 | Tgex 207B7 huVH4_Q52S58Q61K97insQ98ins-sil (LALA_P331S) |
| 619 | Tgex 207B7 huVH4_Q52S58Q61Q97ins-sil (LALA_P331S) |
| 620 | Tgex 207B7 huVH4_Q52S58Q61Q97insK98ins-sil (LALA_P331S) |
| 621 | Tgex 207B7 huVH4_Q52S58Q61R97ins-sil (LALA_P331S) |
| 622 | Tgex 207B7 huVH4_Q52S58Q61-CDRH3-4-18-sil (LALA_P331S) |
| 623 | Tgex 207B7 huVH4_Q52S58Q61-CDRH3-4-20-sil (LALA_P331S) |
| 624 | Tgex 207B7 huVH4_Q52S58Q61-CDRH3-4-21-sil (LALA_P331S) |
| 625 | Tgex 207B7 huVH4_Q52S58Q61-CDRH3-4-24-sil (LALA_P331S) |
| 626 | Tgex 207B7 huVH4_Q52S58Q61-CDRH3-4-26-sil (LALA_P331S) |
| 627 | Tgex 207B7 huVH4_Q52S58Q61CDRH3-7-30-sil (LALA_P331S) |
| 628 | Tgex 207B7 huVH4_Q52S58Q61CDRH3-7-39-sil (LALA_P331S) |
| 629 | Tgex 207B7 huVH4_Q52S58Q61-CDRH3-4-40-sil (LALA_P331S) |
| 630 | Tgex 207B7 huVH4_Q52S58Q61CDRH3-7-41-sil (LALA_P331S) |
| 631 | Tgex 207B7 huVH4_Q52S58Q61-CDRH3-4-46-sil (LALA_P331S) |
| 632 | Tgex 207B7 huVH4_Q52S58Q61-CDRH3-4-60-sil (LALA_P331S) |
| 633 | Tgex 207B7 huVH4_Q52S58Q61CDRH3-7-63-sil (LALA_P331S) |
| 634 | Tgex 207B7 huVH4_Q52S58Q61CDRH3-7-64-sil (LALA_P331S) |
| 635 | Tgex 207B7 huVH4_Q52S58Q61-CDRH3-4-76-sil (LALA_P331S) |
| 636 | Tgex 207B7 huVH4_Q52S58Q61KPA99T-sil (LALA_P331S) |
| 637 | Tgex 207B7 huVH4_Q52S58Q61-CDRH3-43-sil (LALA_P331S) |
| 638 | Tgex 207B7 huVH4_Q52S58Q61-CDRH3-4-80-sil (LALA_P331S) |
| 639 | Tgex 207B7 huVH4_Q52S58Q61CDRH3-7-82-sil (LALA_P331S) |
| 640 | Tgex 207B7 huVH4_Q52S58Q61-CDRH3-4-84-sil (LALA_P331S) |
| 641 | Tgex 207B7 huVH4_Q52S58Q61-CDRH3-4-90-sil (LALA_P331S) |
| 642 | Tgex 207B7 huVH4_Q52S58Q61-CDRH3-4-92-sil (LALA_P331S) |
| 643 | Tgex 207B7 huVH4_Q52S58Q61-CDRH3-4-96-sil (LALA_P331S) |
| 644 | Tgex 207B7 huVH4_W50Q61A97A99 IgG1 |
| 645 | HuVH4-QRGG_M34 |
| 646 | huVH4_T32Q35Q61K97Q99 IgG |
| 647 | huVH4_T32Q61A62K97G99 IgG |
| 648 | huVH4_T32Q61K97G99 IgG |
| 649 | HuVH4-QRGG_Y32A33N35 |
| 650 | HuVH4-QRGG_CDR1germ |
| 680 | Tgex 207B7huVL3_I29M33D56H90S93 |
| 681 | Tgex 207B7huVL3_I29M33D56Y87H90S93 |
| 682 | Tgex 207B7huVL3_I29M33E56H90S93 |
| 683 | Tgex 207B7huVL3_I29M33E56Y87H90S93 |
| 684 | Tgex 207B7huVL3_I29M33H90S93 |
| 685 | Tgex 207B7huVL3_I29M33Y87H90S93 |
| 686 | Tgex 207B7 huVL3_I29M33G34D56H90S93 |
| 687 | Tgex 207B7 huVL3_I29M33G34D56Y87H90S93 |
| 688 | Tgex 207B7huVL3_I29M33G34E56H90S93 |
| 689 | Tgex 207B7huVL3_I29M33G34E56Y87H90S93 |
| 690 | Tgex 207B7huVL3_I29M33G34H90S93 |
| 691 | Tgex 207B7huVL3_I29M33G34Y87H90S93 |
| 692 | Tgex 207B7huVL3_I29D56H90S93 |
| 693 | Tgex 207B7huVL3_I29D56Y87H90S93 |
| 694 | Tgex 207B7huVL3_I29E56H90S93 |
| 695 | Tgex 207B7huVL3_I29E56Y87H90S93 |
| 696 | HuVL3_H90S93_V29I |
| 697 | Tgex 207B7huVL3_I29Y87H90S93 |
| 698 | Tgex 207B7huVL3_I29G34D56H90S93 |
| 699 | Tgex 207B7huVL3_I29G34D56Y87H90S93 |
| 700 | Tgex 207B7huVL3_I29G34E56H90S93 |
| 701 | Tgex 207B7huVL3_I29G34E56Y87H90S93 |
| 702 | Tgex 207B7huVL3_I29G34H90S93 |
| 703 | Tgex 207B7huVL3_I29G34Y87H90S93 |
| 704 | Hu-VL3_N29H90S93 |
| 705 | Hu-VL3_P29H90S93 |
| 706 | Hu-VL3_Q29H90S93 |
| 707 | Hu-VL3_R29H90S93 |
| 708 | Hu-VL3_S29H90S93 |
| 709 | Hu-VL3_T29H90S93 |

-continued

| SEQ ID NO: | Polypeptide Sequence of |
|---|---|
| 710 | Hu-VL3_A30H90S93 |
| 711 | Hu-VL3_D30H90S93 |
| 712 | Hu-VL3_G30H90S93 |
| 713 | Hu-VL3_I30H90S93 |
| 714 | Hu-VL3_K30H90S93 |
| 715 | Hu-VL3_N30H90S93 |
| 716 | HuVL3_H90S93_Y31N |
| 717 | Hu-VL3_A32H90S93 |
| 718 | Hu-VL3_D32H90S93 |
| 719 | Hu-VL3_F32H90S93 |
| 720 | Hu-VL3_G32H90S93 |
| 721 | Hu-VL3_H32H90S93 |
| 722 | Hu-VL3_L32H90S93 |
| 723 | Hu-VL3_A33H90S93 |
| 724 | Hu-VL3_I33H90S93 |
| 725 | Hu-VL3_K33H90S93 |
| 726 | HuVL3_H90S93_V33L |
| 727 | Tgex 207B7huVL3_M33D56H90S93 |
| 728 | Tgex 207B7huVL3_M33D56Y87H90S93 |
| 729 | Tgex 207B7huVL3_M33E56H90S93 |
| 730 | Tgex 207B7huVL3_M33E56Y87H90S93 |
| 731 | Hu-VL3_M33H90S93 |
| 732 | Tgex 207B7huVL3_M33Y87H90S93 |
| 733 | Tgex 207B7huVL3_M33G34D56H90S93 |
| 734 | Tgex 207B7huVL3_M33G34D56Y87H90S93 |
| 735 | Tgex 207B7huVL3_M33G34E56H90S93 |
| 736 | Tgex 207B7huVL3_M33G34E56Y87H90S93 |
| 737 | Tgex 207B7huVL3_M33G34H90S93 |
| 738 | Tgex 207B7huVL3_M33G34Y87H90S93 |
| 739 | Hu-VL3_P33H90S93 |
| 740 | HuVL3_H90S93_Y50A |
| 741 | HuVL3_H90S93_YRY-DLE |
| 742 | HuVL3_H90S93_Y50D |
| 743 | HuVL3_H90S93_S52A |
| 744 | HuVL3_H90S93_N53A |
| 745 | Hu-VL3_D53H90S93 |
| 746 | Hu-VL3_E53H90S93 |
| 747 | huVL3_K53D56H90D93 |
| 748 | huVL3_K53D56H90S93 |
| 749 | huVL3_K53K56H90D93 |
| 750 | huVL3_K53K56H90S93 |
| 751 | huVL3_K53H90D93 |
| 752 | Hu-VL3_K53H90S93 |
| 753 | HuVL3_H90S93_R54A |
| 754 | Hu-VL3_G54H90S93 |
| 755 | Hu-VL3_K54H90S93 |
| 756 | HuVL3_H90S93_RY-LE |
| 757 | HuVL3_H90S93_R54L |
| 758 | HuVL4_H90S93_D1S |
| 759 | HuVL3_H90S93_Y55A |
| 760 | HuVL3_H90S93_Y55E |
| 761 | HuVL3_H90S93_T56A |
| 762 | huVL3_D56H90D93 |
| 763 | Tgex207B7huVL3_D56Y87H90S93 |
| 764 | Tgex207B7huVL3_E56Y87H90S93 |
| 765 | huVL3_K56H90D93 |
| 766 | Hu-VL3_L89H90S93 |
| 767 | Hu-VL3_L89 |
| 768 | Hu-VL3_A90S93 |
| 769 | Hu-VL3_G90S93 |
| 770 | Hu-VL3_H90A91S93 |
| 771 | Hu-VL3_H90D91S93 |
| 772 | Hu-VL3_H90F91S93 |
| 773 | Hu-VL3_H90G91S93 |
| 774 | HuVL3_H90S93_Y92D |
| 775 | Hu-VL3_H90L92A93 |
| 776 | Hu-VL3_H90L92S93 |
| 777 | HuVL3_Q90H_A93 |
| 778 | HuVL3_Q90H_D93 |
| 779 | HuVL3_Q90H_E93 |
| 780 | HuVL3_Q90H_F93 |
| 781 | HuVL3_Q90H_G93 |
| 782 | HuVL3_Q90H_H93 |
| 783 | HuVL3_Q90H_I93 |
| 784 | HuVL3_Q90H_K93 |

-continued

| SEQ ID NO: | Polypeptide Sequence of |
|---|---|
| 785 | HuVL3_Q90H_L93 |
| 786 | HuVL3_Q90H_M93 |
| 787 | Hu-VL3_H90Y97 |
| 788 | HuVL3_Q90H_P93 |
| 789 | HuVL3_Q90H_Q93 |
| 790 | HuVL3_Q90H_R93 |
| 791 | Hu-VL3_H90S93A94 |
| 792 | Hu-VL3_H90S93D94 |
| 793 | Hu-VL3_H90S93F94 |
| 794 | Hu-VL3_H90S93G94 |
| 795 | Hu-VL3_H90S93I94 |
| 796 | HuVL3_H90S93_S94L |
| 797 | Hu-VL3_H90S93N94 |
| 798 | Hu-VL3_H90S93R94 |
| 799 | Hu-VL3_H90S93E96 |
| 800 | Hu-VL3_H90S93Y97 |
| 801 | Hu-VL3_H90S93T94 |
| 802 | Hu-VL3_H90S93V94 |
| 803 | Hu-VL3_H90S93W94 |
| 804 | Hu-VL3_H90S93Y94 |
| 805 | HuVL3_Q90H_T93 |
| 806 | HuVL3_Q90H_V93 |
| 807 | HuVL3_Q90H_W93 |
| 808 | HuVL3_Q90H_Y93 |
| 809 | Hu-VL3_H90L91S93 |
| 810 | Hu-VL3_H90R91S93 |
| 811 | Hu-VL3_H90S91S93 |
| 812 | Hu-VL3_H90T91S93 |
| 813 | Hu-VL3_H90W91S93 |
| 814 | HuVL3_H90S93_H91Y |
| 815 | Hu-VL3_L90S93 |
| 816 | Hu-VL3_N90S93 |
| 817 | Hu-VL3_L92A93 |
| 818 | Hu-VL3_L92 |
| 819 | Hu-VL3_E96 |
| 820 | Hu-VL3_Y97 |
| 821 | Hu-VL3_S90S93 |
| 822 | Hu-VL3_T90S93 |
| 823 | Hu-VL3_V90S93 |
| 824 | Hu-VL3_S89H90S93 |
| 825 | Hu-VL3_S89 |
| 826 | HuVL3_H90S93_F87Y |
| 827 | Hu-VL3_S54H90S93 |
| 828 | huVL3_Q53D56H90D93 |
| 829 | huVL3_Q53D56H90S93 |
| 830 | huVL3_Q53H90D93 |
| 831 | Hu-VL3_Q53H90S93 |
| 832 | Hu-VL3_R53H90S93 |
| 833 | Hu-VL3_S53H90S93 |
| 834 | Hu-VL3_T53H90S93 |
| 835 | Hu-VL3_Y53H90S93 |
| 836 | Hu-VL3_D34H90S93 |
| 837 | Hu-VL3_E34H90S93 |
| 838 | Tgex 207B7huVL3_G34D56H90S93 |
| 839 | Tgex 207B7huVL3_G34D56Y87H90S93 |
| 840 | Tgex 207B7huVL3_G34E56H90S93 |
| 841 | Tgex 207B7huVL3_G34E56Y87H90S93 |
| 842 | Hu-VL3_G34H90S93 |
| 843 | Tgex 207B7huVL3_G34Y87H90S93 |
| 844 | Hu-VL3_H34H90S93 |
| 845 | HuVL3_H90S93_A34N |
| 846 | Hu-VL3_Q34H90S93 |
| 847 | Hu-VL3_S34H90S93 |
| 848 | Hu-VL3_T34H90S93 |
| 849 | Hu-VL3_Y34H90S92 |
| 850 | Hu-VL3_Y33H90S93 |
| 851 | Hu-VL3_Q32H90S93 |
| 852 | Hu-VL3_S32H90S93 |
| 853 | Hu-VL3_T32H90S93 |
| 854 | Hu-VL3_W32H90S93 |
| 855 | HuVL3_H90S93_N32Y |
| 856 | HuVL3_H90S93_R30S |
| 857 | Hu-VL3_T30H90S93 |
| 858 | Hu-VL3_V30H90S93 |
| 859 | Hu-VL3_Y30H90S93 |

-continued

| SEQ ID NO: | Polypeptide Sequence of |
|---|---|
| 860 | Hu-VL3_T28H90S93 |
| 861 | Hu-VL3_V28H90S93 |
| 862 | Hu-VL3_Y28H90S93 |
| 863 | Hu-VL3_T26H90S93 |
| 864 | Hu-VL3_G25H90S93 |
| 865 | Hu-VL3_L25H90S93 |
| 866 | Hu-VL3_R25H90S93 |
| 867 | Hu-VL3_S25H90S93 |
| 868 | Hu-VL3_T25H90S93 |
| 869 | Hu-VL3_R24H90S93 |
| 870 | Hu-VL3_S24H90S93 |
| 871 | Hu-VL3_T24H90S93 |
| 872 | TGEX-LC Human Kappa 207B7 germline |
| 873 | TGEX-LC Human Kappa 207B7 germline 169A1 CDRs |
| 874 | TGEX-LC Human Kappa 207B7 169A1 LCA |
| 875 | TGEX-LC Human Kappa 169A1 |
| 876 | TGEX-LC Human Kappa 207B7mGF Q90H_(was previously 207B7 germline 207B7 169A1 CDRs) |
| 877 | TGEX-LC Human Kappa 207B7 germline 207B7 CDRs |
| 878 | TGEX-LC Human Kappa 207B7 (LPAR1) |
| 879 | HuVL3_H90S93_S1A |
| 880 | huVL3_Q90H_S93_VL |
| 881 | HuVL3_H90S93_S1N |
| 882 | HuVL3_H90S93_S1E |
| 883 | HuVL3_H90S93_S1Q |
| 884 | AA_huVL3_Q90H_VL |
| 885 | AA_207B7_huVL3_VL |
| 886 | huVL3_S93_VL |
| 887 | HuVL3_H90S93_Q27E |
| 888 | HuVL3_H90S93_Q27K |
| 889 | HuVL3_H90S93_Q27L |
| 890 | HuVL3_H90S93_Q27M |
| 891 | HuVL3_H90S93_Q27V |
| 892 | HuVL3_H90S93_Q27W |
| 893 | HuVL3_H90S93_Q27A |
| 894 | HuVL3_H90S93_Q27D |
| 895 | HuVL3_H90S93_Q27F |
| 896 | HuVL3_H90S93_Q27G |
| 897 | HuVL3_H90S93_Q27H |
| 898 | HuVL3_H90S93_Q27I |
| 899 | HuVL3_H90S93_Q27N |
| 900 | HuVL3_H90S93_Q27P |
| 901 | HuVL3_H90S93_Q27R |
| 902 | HuVL3_H90S93_Q27S |
| 903 | HuVL3_H90S93_Q27T |
| 904 | HuVL3_H90S93_Q27Y |
| 905 | HuVL3_H90S93_V31D |
| 906 | HuVL3_H90S93_Y31H |
| 907 | HuVL3_H90S93_Y31F |
| 908 | HuVL3_H90S93_Y31G |
| 909 | HuVL3_H90S93_Y31I |
| 910 | HuVL3_H90S93_Y31P |
| 911 | HuVL3_H90S93_Y31S |
| 912 | HuVL3_H90S93_Y31T |
| 913 | HuVL3_H90S93_Y31E |
| 914 | HuVL3_H90S93_Y31K |
| 915 | HuVL3_H90S93_Y31L |
| 916 | HuVL3_H90S93_Y31M |
| 917 | HuVL3_H90S93_Y31Q |
| 918 | HuVL3_H90S93_Y31R |
| 919 | HuVL3_H90S93_Y31V |
| 920 | HuVL3_H90S93_Y31W |
| 921 | HuVL3_H90S93_Y50E |
| 922 | HuVL3_H90S93_Y50F |
| 923 | HuVL3_H90S93_Y50G |
| 924 | HuVL3_H90S93_Y50H |
| 925 | HuVL3_H90S93_Y50I |
| 926 | HuVL3_H90S93_Y50K |
| 927 | HuVL3_H90S93_Y50L |
| 928 | HuVL3_H90S93_Y50M |
| 929 | HuVL3_H90S93_Y50N |
| 930 | HuVL3_H90S93_Y50P |
| 931 | HuVL3_H90S93_Y50Q |

| SEQ ID NO: | Polypeptide Sequence of |
|---|---|
| 932 | HuVL3_H90S93_Y50R |
| 933 | HuVL3_H90S93_Y50S |
| 934 | HuVL3_H90S93_Y50T |
| 935 | HuVL3_H90S93_Y50V |
| 936 | HuVL3_H90S93_Y50W |
| 937 | HuVL3_H90S93_S52G |
| 938 | HuVL3_H90S93_S52D |
| 939 | HuVL3_H90S93_S52F |
| 940 | HuVL3_H90S93_S52H |
| 941 | HuVL3_H90S93_S52I |
| 942 | HuVL3_H90S93_S52N |
| 943 | HuVL3_H90S93_S52P |
| 944 | HuVL3_H90S93_S52T |
| 945 | HuVL3_H90S93_S52Y |
| 946 | HuVL3_H90S93_T56I |
| 947 | HuVL3_H90S93_T56K |
| 948 | HuVL3_H90S93_T56M |
| 949 | HuVL3_H90S93_T56N |
| 950 | HuVL3_H90S93_T56R |
| 951 | HuVL3_H90S93_S52E |
| 952 | HuVL3_H90S93_S52K |
| 953 | HuVL3_H90S93_S52L |
| 954 | HuVL3_H90S93_S52M |
| 955 | HuVL3_H90S93_S52Q |
| 956 | HuVL3_H90S93_S52R |
| 957 | HuVL3_H90S93_S52V |
| 958 | HuVL3_H90S93_S52W |
| 959 | HuVL3_H90S93_Y55D |
| 960 | HuVL3_H90S93_Y55H |
| 961 | HuVL3_H90S93_Y55N |
| 962 | HuVL3_H90S93_Y55F |
| 963 | HuVL3_H90S93_Y55G |
| 964 | HuVL3_H90S93_Y55I |
| 965 | HuVL3_H90S93_Y55P |
| 966 | HuVL3_H90S93_Y55S |
| 967 | HuVL3_H90S93_Y55T |
| 968 | HuVL3_H90S93_Y55K |
| 969 | HuVL3_H90S93_Y55L |
| 970 | HuVL3_H90S93_Y55M |
| 971 | HuVL3_H90S93_Y55Q |
| 972 | HuVL3_H90S93_Y55R |
| 973 | HuVL3_H90S93_Y55V |
| 974 | HuVL3_H90S93_Y55W |
| 975 | HuVL3_H90S93_T56D |
| 976 | HuVL3_H90S93_T56E |
| 977 | HuVL3_H90S93_T56F |
| 978 | HuVL3_H90S93_T56G |
| 979 | HuVL3_H90S93_T56H |
| 980 | HuVL3_H90S93_T56L |
| 981 | HuVL3_H90S93_T56P |
| 982 | HuVL3_H90S93_T56Q |
| 983 | HuVL3_H90S93_T56S |
| 984 | HuVL3_H90S93_T56V |
| 985 | HuVL3_H90S93_T56W |
| 986 | HuVL3_H90S93_T56Y |
| 987 | TGEXLC_Human_Kappa_204B4_(LPAR1) |
| 988 | 187D6_VL |
| 989 | Tgex huVH4_Q61A75CDRH343__sil_(LALA_P331S) |
| 990 | Tgex huVH4_Q61H96P97P98T99T100b__sil_(LALA_P331S) |
| 991 | Tgex huVH4_Q61H96P98T100b__sil_(LALA_P331S) |
| 992 | Tgex huVH4_Q61K96P97P98T99T100b__sil_(LALA_P331S) |
| 993 | Tgex huVH4_Q61K96P97T99__sil_( LALA_P331S) |
| 994 | Tgex huVH4_Q61S75CDRH343__sil_(LALA_P331S) |
| 995 | 189E7_VL |
| 996 | 186A3_VH |
| 997 | 187D6_VH |
| 998 | 189A11mGF_VH |
| 999 | 189E7_VH |
| 1000 | 207B7HuVH4_H97K98S99 |
| 1001 | 207B7HuVH4_Q61G97K98G99 |
| 1002 | 207B7HuVH4_Q61G97K98S99 |
| 1003 | 207B7HuVH4_Q61H97K98G99 |
| 1004 | 207B7HuVH4_Q61H97K98S99 |
| 1005 | 207B7HuVH4_Q61H97S98G99 |
| 1006 | 207B7HuVH4_Q61H97S98S99 |

| SEQ ID NO: | Polypeptide Sequence of |
|---|---|
| 1007 | 207B7_S100G_VH |
| 1008 | 207B7_mGF_E61A_VH |
| 1009 | 207B7_mGF_F96A_VH |
| 1010 | 207B7_mGF_G55A_VH |
| 1011 | 207B7_mGF_G97A_VH |
| 1012 | 207B7_mGF_L52A_VH |
| 1013 | 207B7_mGF_N58A_VH |
| 1014 | 207B7_mGF_N60A_VH |
| 1015 | 207B7_mGF_P52AA_VH |
| 1016 | 207B7_mGF_R53A_VH |
| 1017 | 207B7_mGF_S54A_VH |
| 1018 | 207B7_mGF_S98A_VH |
| 1019 | 207B7_mGF_S99A_VH |
| 1020 | 207B7_mGF_T57A_VH |
| 1021 | 207B7_mGF_Y100AA_VH |
| 1022 | 207B7_mGF_Y56A_VH |
| 1023 | 207B7mGF_D86E_VH |
| 1024 | 207B7mGF_GLCDRH1_VH |
| 1025 | 207B7mGF_GLCDRH3_VH |
| 1026 | 207B7mGF_I34M_VH |
| 1027 | 207B7mGF_L52Y_VH |
| 1028 | 207B7mGF_N58Y_VH |
| 1029 | 207B7mGF_YTNNTY_VH |
| 1030 | 207mGF_189CDRmuts_VH |
| 1031 | 207mGF_E61G_VH |
| 1032 | 207mGF_G55A_E61G_VH |
| 1033 | 207mGF_G55A_VH |
| 1034 | 207mGF_G97D_S98N_VH |
| 1035 | 207mGF_G97D_VH |
| 1039 | 207mGF_M100L_E61G_VH |
| 1037 | 207mGF_M100L_G55A_VH |
| 1038 | 207mGF_M100L_G97D_VH |
| 1039 | 207mGF_M100L_S98N_VH |
| 1040 | 207mGF_M100L_VH |
| 1041 | 207mGF_S98N_VH |
| 1042 | 31D8_VH |
| 1043 | 62A4_VH |
| 1044 | AA_207B7_huVH1_VH |
| 1045 | AA_207B7_huVH3_VH |
| 1046 | AA_207B7_huVH4_VH |
| 1047 | TGEXHC_Human_IgG1_189A11 |
| 1048 | TGEXHC_Human_IgG1_189B8 |
| 1049 | TGEXHC_Human_IgG1_92E9 |
| 1050 | TGEXHC_Human_IgG1_92C5 |
| 1051 | TGEXHC_silenced_Human_IgG1_140D6_(LPAR1) |
| 1052 | TGEXHC_silenced_Human_IgG1_204B4_(LPAR1) |
| 1053 | huVH4_Q61R97G99G104_Fab_F96A |
| 1054 | huVH4_Q61R97G99G104_Fab_F96D |
| 1055 | huVH4_Q61R97G99G104_Fab_F96E |
| 1056 | huVH4_Q61R97G99G104_Fab_F96G |
| 1057 | huVH4_Q61R97G99G104_Fab_F96H |
| 1058 | huVH4_Q61R97G99G104_Fab_F96I |
| 1059 | huVH4_Q61R97G99G104_Fab_F96K |
| 1060 | huVH4_Q61R97G99G104_Fab_F96L |
| 1061 | huVH4_Q61R97G99G104_Fab_F96M |
| 1062 | huVH4_Q61R97G99G104_Fab_F96N |
| 1063 | huVH4_Q61R97G99G104_Fab_F96P |
| 1064 | huVH4_Q61R97G99G104_Fab_F96Q |
| 1065 | huVH4_Q61R97G99G104_Fab_F96R |
| 1066 | huVH4_Q61R97G99G104_Fab_F96S |
| 1067 | huVH4_Q61R97G99G104_Fab_F96T |
| 1068 | huVH4_Q61R97G99G104_Fab_F96V |
| 1069 | huVH4_Q61R97G99G104_Fab_F96W |
| 1070 | huVH4_Q61R97G99G104_Fab_F96Y |
| 1071 | huVH4_Q61R97G99G104_Fab_G62A |
| 1072 | huVH4_Q61R97G99G104_Fab_G62D |
| 1073 | huVH4_Q61R97G99G104_Fab_G62E |
| 1074 | huVH4_Q61R97G99G104_Fab_G62F |
| 1075 | huVH4_Q61R97G99G104_Fab_G62H |
| 1076 | huVH4_Q61R97G99G104_Fab_G62I |
| 1077 | huVH4_Q61R97G99G104_Fab_G62K |
| 1078 | huVH4_Q61R97G99G104_Fab_G62L |
| 1079 | huVH4_Q61R97G99G104_Fab_G62M |
| 1080 | huVH4_Q61R97G99G104_Fab_G62N |
| 1081 | huVH4_Q61R97G99G104_Fab_G62P |

-continued

-continued

| SEQ ID NO: | Polypeptide Sequence of |
|---|---|
| 1082 | huVH4_Q61R97G99G104_Fab_G62Q |
| 1083 | huVH4_Q61R97G99G104_Fab_G62R |
| 1084 | huVH4_Q61R97G99G104_Fab_G62S |
| 1085 | huVH4_Q61R97G99G104_Fab_G62T |
| 1086 | huVH4_Q61R97G99G104_Fab_G62V |
| 1087 | huVH4_Q61R97G99G104_Fab_G62W |
| 1088 | huVH4_Q61R97G99G104_Fab_G62Y |
| 1089 | huVH4_Q61R97G99G104_Fab_N60D |
| 1090 | huVH4_Q61R97G99G104_Fab_N60E |
| 1091 | huVH4_Q61R97G99G104_Fab_N60F |
| 1092 | huVH4_Q61R97G99G104_Fab_N60G |
| 1093 | huVH4_Q61R97G99G104_Fab_N60H |
| 1094 | huVH4_Q61R97G99G104_Fab_N60I |
| 1095 | huVH4_Q61R97G99G104_Fab_N60K |
| 1096 | huVH4_Q61R97G99G104_Fab_N60L |
| 1097 | huVH4_Q61R97G99G104_Fab_N60M |
| 1098 | huVH4_Q61R97G99G104_Fab_N60P |
| 1099 | huVH4_Q61R97G99G104_Fab_N60Q |
| 1100 | huVH4_Q61R97G99G104_Fab_N60R |
| 1101 | huVH 4 Q61R97G99G104_Fab_N60S |
| 1102 | huVH4_Q61R97G99G104_Fab_N60T |
| 1103 | huVH4_Q61R97G99G104_Fab_N60V |
| 1104 | huVH4_Q61R97G99G104_Fab_N60W |
| 1105 | huVH4_Q61R97G99G104_Fab_N60Y |
| 1106 | huVH4_Q61R97G99G104_Fab_R100A |
| 1107 | huVH4_Q61R97G99G104_Fab_R100D |
| 1108 | huVH4_Q61R97G99G104_Fab_R100E |
| 1109 | huVH4_Q61R97G99G104_Fab_R100F |
| 1110 | huVH4_Q61R97G99G104_Fab_R100G |
| 1111 | huVH4_Q61R97G99G104_Fab_R100H |
| 1112 | huVH4_Q61R97G99G104_Fab_R100I |
| 1113 | huVH4_Q61R97G99G104_Fab_R100K |
| 1114 | huVH4_Q61R97G99G104_Fab_R100L |
| 1115 | huVH4_Q61R97G99G104_Fab_R100M |
| 1116 | huVH4_Q61R97G99G104_Fab_R100N |
| 1117 | huVH4_Q61R97G99G104_Fab_R100P |
| 1118 | huVH4_Q61R97G99G104_Fab_R100Q |
| 1119 | huVH4_Q61R97G99G104_Fab_R100S |
| 1120 | huVH4_Q61R97G99G104_Fab_R100T |
| 1121 | huVH4_Q61R97G99G104_Fab_R100V |
| 1122 | huVH4_Q61R97G99G104_Fab_R100W |
| 1123 | huVH4_Q61R97G99G104_Fab_R100V |
| 1124 | huVH4_Q61R97G99G104_Fab_S31D |
| 1125 | huVH4_Q61R97G99G104_Fab_S31E |
| 1126 | huVH4_Q61R97G99G104_Fab_S31F |
| 1127 | huVH4_Q61R97G99G104_Fab_S31G |
| 1128 | huVH4_Q61R97G99G104_Fab_S31H |
| 1129 | huVH4_Q61R97G99G104_Fab_S31I |
| 1130 | huVH4_Q61R97G99G104_Fab_S31K |
| 1131 | huVH4_Q61R97G99G104_Fab_S31L |
| 1132 | huVH4_Q61R97G99G104_Fab_S31M |
| 1133 | huVH4_Q61R97G99G104_Fab_S31N |
| 1134 | huVH4_Q61R97G99G104_Fab_S31P |
| 1135 | huVH4_Q61R97G99G104_Fab_S31Q |
| 1136 | huVH4_Q61R97G99G104_Fab_S31R |
| 1137 | huVH4_Q61R97G99G104_Fab_S31T |
| 1138 | huVH4_Q61R97G99G104_Fab_S31V |
| 1139 | huVH4_Q61R97G99G104_Fab_S31W |
| 1140 | huVH4_Q61R97G99G104_Fab_S31Y |
| 1141 | huVH4_Q61R97G99G104_Fab_S32D |
| 1142 | huVH4_Q61R97G99G104_Fab_S32E |
| 1143 | huVH4_Q61R97G99G104_Fab_S32F |
| 1144 | huVH4_Q61R97G99G104_Fab_S32G |
| 1145 | huVH4_Q61R97G99G104_Fab_S32H |
| 1146 | huVH4_Q61R97G99G104_Fab_S32I |
| 1147 | huVH4_Q61R97G99G104_Fab_S32K |
| 1148 | huVH4_Q61R97G99G104_Fab_S32L |
| 1149 | huVH4_Q61R97G99G104_Fab_S32M |
| 1150 | huVH4_Q61R97G99G104_Fab_S32N |
| 1151 | huVH4_Q61R97G99G104_Fab_S32P |
| 1152 | huVH4_Q61R97G99G104_Fab_S32Q |
| 1153 | huVH4_Q61R97G99G104_Fab_S32R |
| 1154 | huVH4_Q61R97G99G104_Fab_S32T |
| 1155 | huVH4_Q61R97G99G104_Fab_S32V |
| 1156 | huVH4_Q61R97G99G104_Fab_S32W |

| SEQ ID NO: | Polypeptide Sequence of |
|---|---|
| 1157 | huVH4_Q61R97G99G104_Fab_S35D |
| 1158 | huVH4_Q61R97G99G104_Fab_S35E |
| 1159 | huVH4_Q61R97G99G104_Fab_S35F |
| 1160 | huVH4_Q61R97G99G104_Fab_S35G |
| 1161 | huVH4_Q61R97G99G104_Fab_S35H |
| 1162 | huVH4_Q61R97G99G104_Fab_S35I |
| 1163 | huVH4_Q61R97G99G104_Fab_S35K |
| 1164 | huVH4_Q61R97G99G104_Fab_S35L |
| 1165 | huVH4_Q61R97G99G104_Fab_S35M |
| 1166 | huVH4_Q61R97G99G104_Fab_S35P |
| 1167 | huVH4_Q61R97G99G104_Fab_S35Q |
| 1168 | huVH4_Q61R97G99G104_Fab_S35R |
| 1169 | huVH4_Q61R97G99G104_Fab_S35T |
| 1170 | huVH4_Q61R97G99G104_Fab_S35V |
| 1171 | huVH4_Q61R97G99G104_Fab_S35W |
| 1172 | huVH4_Q61R97G99G104_Fab_S35Y |
| 1173 | huVH4_Q61R97G99G104_Fab_Y100aA |
| 1174 | huVH4_Q61R97G99G104_Fab_Y100aD |
| 1175 | huVH4_Q61R97G99G104_Fab_Y100aE |
| 1176 | huVH4_Q61R97G99G104_Fab_Y100aF |
| 1177 | huVH4_Q61R97G99G104_Fab_Y100aG |
| 1178 | huVH4_Q61R97G99G104_Fab_Y100aH |
| 1179 | huVH4_Q61R97G99G104_Fab_Y100aI |
| 1180 | huVH4_Q61R97G99G104_Fab_Y100aK |
| 1181 | huVH4_Q61R97G99G104_Fab_Y100aL |
| 1182 | huVH4_Q61R97G99G104_Fab_Y100aM |
| 1183 | huVH4_Q61R97G99G104_Fab_Y100aN |
| 1184 | huVH4_Q61R97G99G104_Fab_Y100aP |
| 1185 | huVH4_Q61R97G99G104_Fab_Y100aQ |
| 1186 | huVH4_Q61R97G99G104_Fab_Y100aR |
| 1187 | huVH4_Q61R97G99G104_Fab_Y100aS |
| 1188 | huVH4_Q61R97G99G104_Fab_Y100aT |
| 1189 | huVH4_Q61R97G99G104_Fab_Y100aV |
| 1190 | huVH4_Q61R97G99G104_Fab_Y100aW |
| 1191 | 186A3_VL |
| 1192 | 31D8_VL |
| 1193 | 62A4_VL |
| 1194 | AA_207B7_huVL2_VL |
| 1195 | AA_207B7_huVL4_VL |
| 1196 | TGEXLC_Human_Kappa_140D6_(LPAR1) |
| 1197 | TGEXLC_Human_Kappa_192E9 |
| 1198 | TGEXLC_Human_Kappa_92C5 |
| 1199 | 207B7mGF_H91A_VL |
| 1200 | 207B7mGF_L96A_VL |
| 1201 | 207B7mGF_N32A_VL |
| 1202 | 207B7mGF_N93A_VL |
| 1203 | 207B7mGF_P95A_VL |
| 1204 | 207B7mGF_Q27A_VL |
| 1205 | 207B7mGF_Q90A_VL |
| 1206 | 207B7mGF_R30A_VL |
| 1207 | 207B7mGF_S28A_VL |
| 1208 | 207B7mGF_S94A_VL |
| 1209 | 207B7mGF_T97A_VL |
| 1210 | 207B7mGF_V29A_VL |
| 1211 | 207B7mGF_V33A_VL |
| 1212 | 207B7mGF_Y31A_VL |
| 1213 | AA_207B7_huVL1_VL |
| 1214 | LCA_G30R_Q90H_VL |
| 1215 | LCA_G30R_VL |
| 1216 | LCA_Q90H_S93N_VL |
| 1217 | TGEXLC_Human_Kappa_189A11 |
| 1218 | TGEXLC_Human_Kappa_189B8 |
| 1219 | 15 light chain |
| 1220 | 17 heavy chain |
| 1221 | 18 light chain |
| 1222 | Mouse LPAR1 |
| 1223 | Guinea-pig LPAR1 |
| 1224 | Rabbit LPAR1 |
| 1225 | Human LPAR2 |
| 1226 | Human LPAR3 |
| 1227 | Isotype antibody VH |
| 1228 | Isotype antibody VL |
| 1229 | Human LPAR1 |
| 1230 | Human LPAR2 |
| 1231 | Human LPAR3 |

| SEQ ID NO: | Polypeptide Sequence of |
|---|---|
| 1232 | Mouse LPAR1 |
| 1233 | Guinea-pig LPAR1 |
| 1234 | Rabbit LPAR1 |
| 1235 | 16 heavy chain constant region (LALA) |
| 1236 | 16 heavy chain |
| 1237 | Fc region with M252Y, S254T and T256E mutations |
| 1238 | Fc region with M252Y, S254T, T256E, LALA mutations |
| 1239 | Fc region with M252Y, S254T, T256E, LALA PS mutations |
| 1240 | Fc region with M252Y, S254T, T256E, LALA PG mutations |
| 1241 | Fc region with M252Y, S254T, T256E, LAGA mutations |
| 1242 | Fc region with H433K, N434F mutations |
| 1243 | Fc region with H433K, N434F, LALA mutations |
| 1244 | Fc region with H433K N434F, LALA PS mutations |
| 1245 | Fc region with H433K, N434F, LALA PG mutations |
| 1246 | Fc region with H433K, N434F, LAGA mutations |
| 1247 | Fc region with H433K, N434F, Y436H mutations |
| 1248 | Fc region with H433K, N434F, Y436H, LALA mutations |
| 1249 | Fc region with H433K, N434F, Y436H, LALA PS mutations |
| 1250 | Fc region with H433K, N434F, Y436H, LALA PG mutations |
| 1251 | Fc region with H433K, N434F, Y436FL LAGA mutations |
| 1252 | Fc region with M252Y, S254T, T256E, H433K, N434F mutations |
| 1253 | Fc region with M252Y, S254T, T256E, H433K, N434F, LALA mutations |
| 1254 | Fc region with M252Y, S254T, T256E, H433K, N434F, LALA PS mutations |
| 1255 | Fc region with M252Y, S254T, T256E, H433K, N434F, LALA PG mutations |
| 1256 | Fc region with M252Y, S254T, T256E, H433K, N434F, LAGA mutations |
| 1257 | Fc region with M252Y, S254T, T256E, H433K, N434F, Y436H mutations |
| 1258 | Fc region with M252Y, S254T, T256E, H433K, N434F, Y436H, LALA mutations |
| 1259 | Fc region with M252Y, S254T, T256E, H433K, N434F, Y436H, LALA PS mutations |
| 1260 | Fc region with M252Y, S254T, T256E, H433K, N434F, Y436H, LALA PG mutations |
| 1261 | Fc region with M252Y, S254T, T256E, H433K, N434F, Y436H, LAGA mutations |
| 1262 | Fc region with M428L, N434S mutations |
| 1263 | Fc region with M428L, N434S, LALA mutations |
| 1264 | Fc region with M428L, N434S, LALA PS mutations |
| 1265 | Fc region with M428L, N434S, LALA PG mutations |
| 1266 | Fc region with M428L, N434S, LAGA mutations |
| 1267 | Fc region with T250Q, M428L mutations |
| 1268 | Fc region with T250Q, M428L LALA mutations |
| 1269 | Fc region with T250Q, M428L LALA PS mutations |
| 1270 | Fc region with T250Q, M428L, LALA PG mutations |
| 1271 | Fc region with T250Q, M428L, LAGA mutations |
| 1272 | Fc region with T307A, E380A, N434A mutations |
| 1273 | Fc region with T307A, E380A, N434A, LALA mutations |
| 1274 | Fc region with T307A, E380A, N434A, LALA PS mutations |
| 1275 | Fc region with T307A, E380A, N434A, LALA PG mutations |
| 1276 | Fc region with T307A, E380A, N434A, LAGA mutations |
| 1277 | Fc region with V308P mutations |
| 1278 | Fc region with V308P, LALA mutations |
| 1279 | Fc region with V308P, LALA PS mutations |
| 1280 | Fc region with V308P, LALA PG mutations |
| 1281 | Fc region with V308P, LAGA mutations |
| 1282 | Fc region with H285D, T307Q, A378V mutations |
| 1283 | Fc region with H285D, T307Q, A378V, LALA mutations |
| 1284 | Fc region with H285D, T307Q, A378V, LALA PS mutations |
| 1285 | Fc region with H285D, T307Q, A378V, LALA PG mutations |
| 1286 | Fc region with H285D, T307Q, A378V, LAGA mutations |
| 1287 | Fc region with L309D, Q311H, N434S mutations |
| 1288 | Fc region with L309D, Q311H, N434S, LALA mutations |
| 1289 | Fc region with L309D, Q311H, N434S, LALA PS mutations |
| 1290 | Fc region with L309D, Q311H, N434S, LALA PG mutations |
| 1291 | Fc region with L309D, Q311H, N434S, LAGA mutations |
| 1292 | Fc region with I253A, H310A, H435A mutations |
| 1293 | Fc region with I253A, H310A, H435A, LALA mutations |
| 1294 | Fc region with I253A, H310A, H435A, LALA PS mutations |
| 1295 | Fc region with I253A, H310A, H435A, LALA PG mutations |
| 1296 | Fc region with I253A, H310A, H435A, LAGA mutations |
| 1297 | Fc region with N434S, Q311I mutations |
| 1298 | Fc region with N434S, Q311I, LALA mutations |
| 1299 | Fc region with N434S, Q311I, LALA PS mutations |
| 1300 | Fc region with N434S, Q311I, LALA PG mutations |
| 1301 | Fc region with N434S, Q311I, LAGA mutations |
| 1302 | Fc region with N434S, Q311V mutations |
| 1303 | Fc region with N434S, Q311V, LALA mutations |
| 1304 | Fc region with N434S, Q311V, LALA PS mutations |
| 1305 | Fc region with N434S, Q311V, LALA PG mutations |
| 1306 | Fc region with N434S, Q311V, LAGA mutations |
| 1307 | Fc region with N434S, Y436I mutations |
| 1308 | Fc region with N434S, Y436I, LALA mutations |
| 1309 | Fc region with N434S, Y436I, LALA PS mutations |
| 1310 | Fc region with N434S, Y436I, LALA PG mutations |
| 1311 | Fc region with N434S, Y436I, LAGA mutations |
| 1312 | Fc region with N434S, Y436V mutations |
| 1313 | Fc region with N434S, Y436V, LALA mutations |
| 1314 | Fc region with N434S, Y436V, LALA PS mutations |
| 1315 | Fc region with N434S, Y436V, LALA PG mutations |
| 1316 | Fc region with N434S, Y436V, LAGA mutations |
| 1317 | Fc region with N434A mutations |
| 1318 | Fc region with N434A, LALA mutations |
| 1319 | Fc region with N434A, LALA PS mutations |
| 1320 | Fc region with N434A, LALA PG mutations |
| 1321 | Fc region with N434A, LAGA mutations |
| 1322 | Fc region with M252Y, V308P, N434Y mutations |
| 1323 | Fc region with M252Y, V308P, N434Y, LALA mutations |
| 1324 | Fc region with M252Y, V308P, N434Y, LALA PS mutations |
| 1325 | Fc region with M252Y, V308P, N434Y, LALA PG mutations |
| 1326 | Fc region with M252Y, V308P, N434Y, LAGA mutations |
| 1327 | Fc region with L234F, L235Q, K322Q, M252Y, S254T, T256E mutations |
| 1328 | Fc region with E294delta/T307P/N434Y mutations |
| 1329 | Fc region with E294delta/T307P/N434Y, LALA mutations |
| 1330 | Fc region with E294delta/T307P/N434Y, LALA PS mutations |
| 1331 | Fc region with E294delta/T307P/N434Y, LALA PG mutations |
| 1332 | Fc region with E294delta/T307P/N434Y, LAGA mutations |
| 1333 | Fc region with T256N/A378V/S383N/N434Y mutations |
| 1334 | Fc region with T256N/A378V/S383N/N434Y, LALA mutations |
| 1335 | Fc region with T256N/A378V/S383N/N434Y, LALA PS mutations |
| 1336 | Fc region with T256N/A378V/S383N/N434Y, LALA PG mutations |
| 1337 | Fc region with T256N/A378V/S383N/N434Y, LAGA mutations |
| 1338 | Fc region with E294delta mutation |
| 1339 | Fc region with E294delta LALA mutations |
| 1340 | Fc region with E294delta LALA PS mutations |
| 1341 | Fc region with E294delta LALA PG mutations |
| 1342 | Fc region with E294delta LAGA mutations |
| 1343 | Fc region with T256D/N286D/T307R/Q311V/A378V mutations |
| 1344 | Fc region with T256D/N286D/T307R/ |
| 1345 | Fc region with T256D/N286D/T307R/Q311V/A378V, LALA PS mutations |
| 1346 | Fc region with T256D/N286D/T307R/Q311V/A378V, LALA PG mutations |
| 1347 | Fc region with T256D/N286D/T307R/Q311V/A378V, LAGA mutations |
| 1348 | Fc region with T256D/T307Q mutations |
| 1349 | Fc region with T256D/T307Q, LALA mutations |
| 1350 | Fc region with T256D/T307Q, LALA PS mutations |
| 1351 | Fc region with T256D/T307Q, LALA PG mutations |
| 1352 | Fc region with T256D/T307Q, LAGA mutations |
| 1353 | Fc region with T256D/T307W mutations |
| 1354 | Fc region with T256D/T307W LALA mutations |
| 1355 | Fc region with T256D/T307W LALA PS mutations |
| 1356 | Fc region with T256D/T307W LALA PG mutations |
| 1357 | Fc region with T256D/T307W LALA PG mutations |
| 1358 | Fc region with M252Y/T256D mutations |
| 1359 | Fc region with M252Y/T256D, LALA mutations |
| 1360 | Fc region with M252Y/T256D, LALA PS mutations |
| 1361 | Fc region with M252Y/T256D, LALA PG mutations |
| 1362 | Fc region with M252Y/T256D, LAGA mutations |
| 1363 | Fc region with T307Q/Q311V/A378V mutations |
| 1364 | Fc region with T307Q/Q311V/A378V, LALA mutations |
| 1365 | Fc region with T307Q/Q311V/A378V, LALA PS mutations |
| 1366 | Fc region with T307Q/Q311V/A378V, LALA PG mutations |
| 1367 | Fc region with T307Q/Q311V/A378V, LAGA mutations |
| 1368 | 11 VH |
| 1369 | 12 VH |
| 1370 | 12 VL |

-continued

| SEQ ID NO: | Polypeptide Sequence of |
|---|---|
| 1371 | 15 VL |
| 1372 | 16 VH |
| 1373 | 17 VH |
| 1374 | 18 VL |
| 1375 | Wildtype Fc region |
| 1376 | Fc region with LALA PG mutations |
| 1377 | Fc region with LAGA mutations |

DETAILED DESCRIPTION OF THE INVENTION

Definitions

Unless defined otherwise, all technical and scientific terms used herein have the meaning commonly understood by a person skilled in the art to which this invention belongs. As used herein, the following terms have the meanings ascribed to them below.

Polypeptides are organic polymers consisting of a number of amino acid residues bonded together in a chain. As used herein, 'polypeptide' is used interchangeably with 'protein' and 'peptide'.

The term "antibody" includes any antibody protein construct comprising at least one antibody variable domain comprising at least one antigen binding site (ABS). Antibodies include, but are not limited to, immunoglobulins of types IgA, IgG, IgE, IgD, IgM (as well as subtypes thereof). The overall structure of Immunoglobulin G (IgG) antibodies assembled from two identical heavy (H)-chain and two identical light (L)-chain polypeptides is well established and highly conserved in mammals (Padlan 1994).

"Specificity" refers to the number of different types of antigens or antigenic determinants to which a particular antibody or fragment thereof can bind. The specificity of an antibody is the ability of the antibody to recognise a particular antigen as a unique molecular entity and distinguish it from another. An antibody that "specifically binds" to an antigen or an epitope is a term well understood in the art. A molecule is said to exhibit "specific binding" if it reacts more frequently, more rapidly, with greater duration and/or with greater affinity with a particular target antigen or epitope, than it does with alternative targets. An antibody "specifically binds" to a target antigen or epitope if it binds with greater affinity, avidity, more readily, and/or with greater duration than it binds to other substances. An antibody (or fragment thereof) may be considered to specifically bind to a target if the binding is statistically significant compared to a non-relevant binder. Specific binding of an antibody, or fragment thereof, to an antigen or antigenic determinant can be determined in any suitable known manner, including, for example, Scatchard analysis and/or competitive binding assays, such as radioimmunoassays (RIA), enzyme immunoassays (EIA) and sandwich competition assays, equilibrium dialysis, equilibrium binding, gel filtration, ELISA, or spectroscopy (e.g. using a fluorescence assay) and the different variants thereof known in the art.

"Affinity", represented by the equilibrium constant for the dissociation of an antigen with an antigen-binding polypeptide ($K_D$), is a measure of the binding strength between an antigenic determinant and an antigen-binding site on the antibody (or fragment thereof): the lesser the value of the $K_D$, the stronger the binding strength between an antigenic determinant and the antigen-binding polypeptide. Alternatively, the affinity can also be expressed as the affinity constant (KA), which is $1/K_D$. Affinity can be determined by known methods, depending on the specific antigen of interest. For example $K_D$ may be determined by the method recited in the Examples section under method 1.14. Any $K_D$ value less than $10^{-6}$ is considered to indicate binding. Suitably, polypeptides of the invention will bind with a dissociation constant of $10^{-6}$ M or less, more suitably $10^{-7}$ M or less, more suitably $10^{-8}$ M or less and more suitably $10^{-9}$ M or less.

"Avidity" is the measure of the strength of binding between a polypeptide, an antibody or fragment thereof, and the pertinent antigen. Avidity is related to both the affinity between an antigenic determinant and its antigen binding site on the antibody and the number of pertinent binding sites present on the antibody.

Suitably, the polypeptide of the invention is isolated. An "isolated" polypeptide is one that is removed from its original environment. For example, a naturally-occurring polypeptide of the invention is isolated if it is separated from some or all of the coexisting materials in the natural system. The term "isolated" may also be used to refer to preparations where the isolated polypeptide is sufficiently pure to be administered therapeutically when formulated as an active ingredient of a pharmaceutical composition, or at least 70-80% (w/w) pure, more preferably, at least 80-90% (w/w) pure, even more preferably, 90-95% pure; and, most preferably, at least 95%, 96%, 97%, 98%, 99%, or 100% (w/w) pure.

Suitably, the polynucleotides used in the present invention are isolated. An "isolated" polynucleotide is one that is removed from its original environment. For example, a naturally-occurring polynucleotide is isolated if it is separated from some or all of the coexisting materials in the natural system. A polynucleotide is considered to be isolated if, for example, it is cloned into a vector that is not a part of its natural environment or if it is comprised within cDNA.

For the purposes of comparing two closely-related polypeptide sequences, the "% sequence identity" between a first polypeptide sequence and a second polypeptide sequence may be calculated using NCBI BLAST v2.0, using standard settings for polypeptide sequences (BLASTP). For the purposes of comparing two closely-related polynucleotide sequences, the "% sequence identity" between a first nucleotide sequence and a second nucleotide sequence may be calculated using NCBI BLAST v2.0, using standard settings for nucleotide sequences (BLASTN).

Polypeptide or polynucleotide sequences are said to be the same as or "identical" to other polypeptide or polynucleotide sequences if they share 100% sequence identity over their entire length. Residues in sequences are numbered from left to right, i.e. from N- to C-terminus for polypeptides; from 5' to 3' terminus for polynucleotides.

A "difference" between polypeptide sequences refers to an insertion, deletion or substitution of a single amino acid residue in a position of the second sequence, compared to the first sequence. Two polypeptide sequences can contain one, two or more such amino acid differences. Insertions, deletions or substitutions in a second sequence which is otherwise identical (100% sequence identity) to a first sequence result in reduced % sequence identity. For example, if the identical sequences are 9 amino acid residues long, one substitution in the second sequence results in a sequence identity of 88.9%. If first and second polypeptide sequences are 9 amino acid residues long and share 6 identical residues, the first and second polypeptide sequences share greater than 66% identity (the first and second polypeptide sequences share 66.7% identity).

Alternatively, for the purposes of comparing a first, reference polypeptide sequence to a second, comparison polypeptide sequence, the number of additions, substitutions and/or deletions made to the first sequence to produce the second sequence may be ascertained. An "addition" is the addition of one amino acid residue into the sequence of the first polypeptide (including addition at either terminus of the first polypeptide). A "substitution" is the substitution of one amino acid residue in the sequence of the first polypeptide with one different amino acid residue. Said substitution may be conservative or non-conservative. A "deletion" is the deletion of one amino acid residue from the sequence of the first polypeptide (including deletion at either terminus of the first polypeptide).

Using the three letter and one letter codes, the naturally occurring amino acids may be referred to as follows: glycine (G or Gly), alanine (A or Ala), valine (V or Val), leucine (L or Leu), isoleucine (I or Ile), proline (P or Pro), phenylalanine (F or Phe), tyrosine (Y or Tyr), tryptophan (W or Trp), lysine (K or Lys), arginine (R or Arg), histidine (H or His), aspartic acid (D or Asp), glutamic acid (E or Glu), asparagine (N or Asn), glutamine (Q or Gln), cysteine (C or Cys), methionine (M or Met), serine (S or Ser) and Threonine (T or Thr). Where a residue may be aspartic acid or asparagine, the symbols Asx or B may be used. Where a residue may be glutamic acid or glutamine, the symbols Glx or Z may be used. References to aspartic acid include aspartate, and glutamic acid include glutamate, unless the context specifies otherwise.

A "conservative" amino acid substitution is an amino acid substitution in which an amino acid residue is replaced with another amino acid residue of similar chemical structure and which is expected to have little influence on the function, activity or other biological properties of the polypeptide. Such conservative substitutions suitably are substitutions in which one amino acid within the following groups is substituted by another amino acid residue from within the same group, as shown in Table 1 below.

TABLE 1

| Amino acids | |
| --- | --- |
| Group | Amino acid residue |
| Non-polar aliphatic | Glycine |
| | Alanine |
| | Valine |
| | Methionine |
| | Leucine |
| | Isoleucine |
| Aromatic | Phenylalanine |
| | Tyrosine |
| | Tryptophan |
| Polar uncharged | Serine |
| | Threonine |
| | Cysteine |
| | Proline |
| | Asparagine |
| | Glutamine |
| Negatively charged | Aspartate |
| | Glutamate |
| Positively charged | Lysine |
| | Arginine |
| | Histidine |

Suitably, a hydrophobic amino acid residue is a non-polar amino acid. More suitably, a hydrophobic amino acid residue is selected from V, I, L, M, F, W or C. In some embodiments, a hydrophobic amino acid residue is selected from glycine, alanine, valine, methionine, leucine, isoleucine, phenylalanine, tyrosine, or tryptophan. Suitably, any residues in a sequence which do not correspond to the residues provided in a reference sequence are conservative substitutions with respect to the residues of the reference sequence.

As used herein, numbering of polypeptide sequences and definitions of CDRs and FRs (i.e. HCDR1, HCDR2, HCDR3, HFR1, HFR2, HFR3, HFR4, LCDR1, LCDR2, LCDR3, LFR1, LFR2, LFR3 and LFR4) are as defined according to the Kabat system (Kabat et al., 1991, herein incorporated by reference in its entirety), unless mentioned otherwise. In a limited number of specific embodiments disclosed herein (derived from the residue substitution work performed in Example 7), a non-Kabat numbering system is applied for CDR definition and this is specified when used. A "corresponding" amino acid residue between a first and second polypeptide sequence is an amino acid residue in a first sequence which shares the same position according to the Kabat system with an amino acid residue in a second sequence, whilst the amino acid residue in the second sequence may differ in identity from the first. Suitably corresponding residues will share the same number (and letter) if the framework and CDRs are the same length according to Kabat definition. Alignment can be achieved manually or by using, for example, a known computer algorithm for sequence alignment such as NCBI BLAST v2.0 (BLASTP or BLASTN) using standard settings.

References herein to an "epitope" refer to the portion of the target which is bound by the polypeptide, antibody or fragment thereof. Epitopes may also be referred to as "antigenic determinants". An antibody binds "essentially the same epitope" as another antibody when they both recognize identical or sterically overlapping epitopes. Commonly used methods to determine whether two antibodies bind to identical or overlapping epitopes are competition assays, which can be configured in a number of different formats (e.g. well plates using radioactive or enzyme labels, or flow cytometry on antigen-expressing cells) using either labelled antigen or labelled antibody. An antibody binds "the same epitope" as another antibody when they both recognize identical epitopes (i.e. all contact points between the antigen and the antibody are the same). For example, an antibody may bind the same epitope as another antibody when all contact points across a specified region of an antigen are identified as the same with the aid of a characterization method such as antibody/antigen cross-linking-coupled MS, HDX, X-ray crystallography, cryo-EM, or mutagenesis.

Further, with the aid of such characterization methods, it is also possible to characterize antibodies which bind essentially the same epitope by recognizing some but not all of the identical contact points. Specifically, such antibodies may share a sufficient number of identical contact points in a specified antigenic region to deliver a broadly equivalent technical effect and/or equivalent antigen interaction selectivity. Additionally, in some instances whereby antibodies recognize essentially the same epitope and confer a broadly equivalent technical effect and/or interaction selectivity, it can also be useful to define the epitope binding footprint by the totality of antigen contacts inclusive of the most N-terminal antigen contact point through to the most C-terminal antigen contact point.

Epitopes found on protein targets may be defined as "linear epitopes" or "conformational epitopes". Linear epitopes are formed by a continuous sequence of amino acids in a protein antigen. Conformational epitopes are formed of amino acids that are discontinuous in the protein sequence, but which are brought together upon folding of the protein into its three-dimensional structure.

The term "vector", as used herein, is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian and yeast vectors). Other vectors (e.g. non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include other forms of expression vectors, such as viral vectors (e.g. replication defective retroviruses, adenoviruses and adeno-associated viruses), which serve equivalent functions, and also bacteriophage and phagemid systems. The term "recombinant host cell" (or simply "host cell"), as used herein, is intended to refer to a cell into which a recombinant expression vector has been introduced. Such terms are intended to refer not only to the particular subject cell but to the progeny of such a cell, for example, when said progeny are employed to make a cell line or cell bank which is then optionally stored, provided, sold, transferred, or employed to manufacture a polypeptide, antibody or fragment thereof as described herein.

References to "subject", "patient" or "individual" refer to a subject, in particular a mammalian subject, to be treated. Mammalian subjects include humans, non-human primates, farm animals (such as cows), sports animals, or pet animals, such as dogs, cats, guinea pigs, rabbits, rats or mice. In some embodiments, the subject is a human or a mouse. Most suitably the subject is a human.

The term "sufficient amount" means an amount sufficient to produce a desired effect. The term "therapeutically effective amount" is an amount that is effective to ameliorate a symptom of a disease or disorder. A therapeutically effective amount can be a "prophylactically effective amount" as prophylaxis can be considered therapy.

A disease or disorder is "ameliorated" if the severity of a sign or symptom of the disease or disorder, the frequency with which such a sign or symptom is experienced by a subject, or both, is reduced.

As used herein, "treating a disease or disorder" means reducing the frequency and/or severity of at least one sign or symptom of the disease or disorder experienced by a subject.

"Inflammation" refers to a chronic or acute triggering of the immune system resulting in an inflamed cell, cell type, tissue, or organ.

"Fibrosis" refers to pathological wound healing, wherein connective tissue replaces normal tissue, causing tissue remodelling and formation of scar tissue.

As used herein, the term "about" includes up to and including 10% greater and up to and including 10% lower than the value specified, suitably up to and including 5% greater and up to and including 5% lower than the value specified, especially the value specified. The term "between", includes the values of the specified boundaries.

"Potency" is a measure of the activity of a therapeutic agent expressed in terms of the amount required to produce an effect of given intensity. A highly potent agent evokes a greater response at low concentrations compared to an agent of lower potency that evokes a smaller response at low concentrations. Potency is a function of affinity and efficacy. Efficacy refers to the ability of therapeutic agent to produce a biological response upon binding to a target and the quantitative magnitude of this response. The term half maximal effective concentration (EC50) refers to the concentration of a therapeutic agent which causes a response halfway between the baseline and maximum after a specified exposure time. The therapeutic agent may cause inhibition or stimulation. It is commonly used, and is used herein, as a measure of potency.

Polypeptides which Bind to LPAR1

Polypeptides are said to be binding polypeptides when they contain one or more stretches of amino acid residues which form an antigen-binding site, capable of binding to an epitope on a target antigen with an affinity (suitably expressed as a $K_D$ value, a Ka value, a kon-rate and/or a koff-rate, as further described herein). 'Binding polypeptide' and 'antigen-binding polypeptide' are used synonymously herein, as are the terms 'binds to LPAR1' and 'anti-LPAR1'. A binding polypeptide is suitably capable of exerting a beneficial pharmacological effect upon administration to a subject. Suitably the polypeptide agonises, inversely agonises, antagonises or neutralises, LPAR1. In some embodiments the polypeptide may inversely agonise LPAR1. In some embodiments the polypeptide may bind the external surface of LPAR1, i.e. the extracellular region of LPAR1.

LPAR1 binding polypeptides may include antibodies (which are further described below), antibodies modified to comprise additional binding regions, antibody mimetics and antigen-binding antibody fragments (which are further described below). Further binding polypeptides may include, for example, DARPins (Binz et al. 2003), Affimers™, Fynomers™, Centyrins, Nanofitins® and cyclic peptides.

Antibodies and Fragments Thereof

The polypeptide is preferably an antibody or fragment thereof.

A conventional antibody or immunoglobulin (Ig) is a protein comprising four polypeptide chains: two heavy (H, or HC) chains and two light (L, or LC) chains. Each chain is divided into a constant region and a variable region. The heavy (H) chain variable region is abbreviated herein as VH region, and the light (L) chain variable region is abbreviated herein as VL region. These domains, domains related thereto and domains derived therefrom, are referred to herein as variable domains. The VH and VL regions (or 'domains) can be further subdivided into regions of hypervariability, termed "complementarity determining regions" ("CDRs"), interspersed with regions that are more conserved, termed "framework regions" ("FRs"). The framework and complementarity determining regions have been precisely defined (Kabat et al 1991, herein incorporated by reference in its entirety). In a conventional antibody, each VH and VL region is composed of three CDRs and four FRs, arranged from amino-terminus to carboxy-terminus in the following order: FR1, CDR1, FR2, CDR2, FR3, CDR3, FR4. The VH region CDRs and FRs are denoted HCDR1, HCDR2, HCDR3, HFR1, HFR2, HFR3 and HFR4. The VL region CDRs and FRs are denoted LCDR1, LCDR2, LCDR3, LFR1, LFR2, LFR3 and LFR4. The conventional antibody tetramer of two heavy immunoglobulin chains and two light immunoglobulin chains is formed with the heavy and the light immunoglobulin chains inter-connected by e.g. disulfide bonds, and the heavy chains similarly connected. The heavy chain constant region includes three domains, CH1, CH2 and CH3. The light chain constant region is comprised of one domain, CL. The variable domain of the heavy chains and the variable domain of the light chains are binding domains that interact with an antigen. The constant regions of the antibodies typically mediate the binding of the antibody to host tissues or factors, including various cells of the immune system (e.g. effector cells) and the first component (C1q) of the classical complement system.

A fragment of an antibody (which may also referred to as "antibody fragment", "immunoglobulin fragment", "antigen-binding fragment" or "antigen-binding polypeptide") as used herein refers to a portion of an antibody that specifically binds to the target (e.g. a molecule in which one or more immunoglobulin chains is not full length, but which specifically binds to the target). Examples of binding fragments encompassed within the term antibody fragment include:

(i) a Fab fragment (a monovalent fragment consisting of the VL, VH, CL and CH1 domains);

(ii) a F(ab')2 fragment (a bivalent fragment consisting of two Fab fragments linked by a disulphide bridge at the hinge region);

(iii) a Fd fragment (consisting of the VH and CH1 domains);

(iv) a Fv fragment (consisting of the VL and VH domains of a single arm of an antibody);

(v) a single chain variable fragment, scFv (consisting of VL and VH domains joined, using recombinant methods, by a synthetic linker that enables them to be made as a single protein chain in which the VL and VH regions pair to form monovalent molecules);

(vi) a VH (a variable domain consisting of a VH domain);

(vii) a VL (a variable domain consisting of a VL domain);

(viii) a domain antibody (dAb, consisting of either the VH or VL domain);

(ix) a minibody (consisting of a pair of scFv fragments which are linked via CH3 domains); and (x) a diabody (consisting of a noncovalent dimer of scFv fragments that consist of a VH domain from one antibody connected by a small peptide linker a VL domain from another antibody).

"Human antibody" refers to antibodies having variable and constant regions derived from human germline immunoglobulin sequences. Human subjects administered with said human antibodies do not generate cross-species antibody responses (for example termed HAMA responses—human-anti-mouse antibody) to the primary amino acids contained within said antibodies. Said human antibodies may include amino acid residues not encoded by human germline immunoglobulin sequences (e.g. mutations introduced by random or site-specific mutagenesis or by somatic mutation), for example in the CDRs and in particular CDR3. However, the term is not intended to include antibodies in which CDR sequences derived from the germline of another mammalian species, such as a mouse, have been grafted onto human framework sequences. Human antibodies that are prepared, expressed, created or isolated by recombinant means, such as antibodies expressed using a recombinant expression vector transfected into a host cell, antibodies isolated from a recombinant, combinatorial human antibody library, antibodies isolated from an animal (e.g., a mouse) that is transgenic for human immunoglobulin genes or antibodies prepared, expressed, created or isolated by any other means that involves splicing of human immunoglobulin gene sequences to other DNA sequences, may also be referred to as "recombinant human antibodies".

Substituting at least one amino acid residue in the framework region of a non-human immunoglobulin variable domain with the corresponding residue from a human variable domain is referred to as "humanisation". Humanisation of a variable domain may reduce immunogenicity in humans.

In one embodiment, the antibody or fragment thereof is an scFv, Fab, Fab', F(ab')2, Fv, variable domain (e.g. VH or VL), diabody, minibody or full length antibody. In a particular embodiment, the antibody or fragment thereof is an scFv or a full length antibody.

Antibodies of the invention can be of any class, e.g. IgG, IgA, IgM, IgE, IgD, or subclass thereof, and can comprise a kappa or lambda light chain. In one embodiment, the antibody is an IgG antibody, for example, at least one of subclasses, IgG1, IgG2, IgG3 or IgG4. In one embodiment, the antibody is an IgG1. In a further embodiment, the antibody may be in a format, such as an IgG format, that has been modified to confer desired properties, such as having the Fc mutated to reduce effector function, extend half-life, alter ADCC, or improve hinge stability. Such modifications are well known in the art and exemplary embodiments are described herein. For instance, an antibody or fragment thereof of the invention may comprise an IgG1 heavy chain constant region comprising or consisting of an amino acid sequence according to SEQ ID NO: 56. Suitably, the heavy chain constant region comprises mutations to extend antibody half-life in vivo as described in Booth et al. 2018, Borrok et al. 2017, Dall'Acqua et al. 2006, Dall'Acqua et al. 2002, Datta-Mannan et al. 2012, Hinton et al. 2004, Igawa et al. 2013, Ko et al. 2021, Lee C H et al. 2019, Lie et al. 2020, Mackness et al. 2019, Petkova et al. 2006, Robbie et al. 2013, Saunders 2019, Shields et al. 2001, Vaccaro et al. 2006, Vaccaro et al. 2005, Zalevsky et al. 2010, US2014/056879A1, U.S. Pat. No. 8,088,376B2, WO2006053301, WO2009086320 and WO2018035107 (all incorporated by reference herein for the purpose of the Fc mutations disclosed therein). Suitably, the heavy chain constant region comprises Fc effector-enhancing mutations as described in WO2004029207, WO2004099249 and WO2006019447 (all incorporated by reference herein for the purpose of the Fc mutations disclosed therein).

Suitably, the heavy chain constant region comprises one or more of the following residues:

residue at position 250 is Q, residue at position 252 is Y, residue at position 252 is F, residue at position 252 is W, residue at position 252 is T, residue at position 253 is A, residue at position 254 is T, residue at position 256 is E, residue at position 256 is S, residue at position 256 is R, residue at position 256 is Q, residue at position 256 is D, residue at position 259 is I, residue at position 285 is D, residue at position 285 is N, residue at position 286 is D, residue at position 294 is deleted, residue at position 307 is A, residue at position 307 is Q, residue at position 307 is P, residue at position 307 is R, residue at position 307 is W, residue at position 308 is P, residue at position 308 is F, residue at position 309 is P, residue at position 309 is D, residue at position 309 is N, residue at position 310 is A, residue at position 311 is S, residue at position 311 is I, residue at position 311 is V, residue at position 311 is H, residue at position 315 is D, residue at position 378 is V, residue at position 380 is A, residue at position 385 is R, residue at position 385 is D, residue at position 385 is S, residue at position 385 is T, residue at position 385 is H, residue at position 385 is K, residue at position 385 is A, residue at position 385 is G, residue at position 386 is T, residue at position 386 is P, residue at position 386 is D, residue at position 386 is S, residue at position 386 is K, residue at position 386 is R, residue at position 386 is I, residue at position 386 is M, residue at position 387 is R, residue at position 387 is P, residue at position 387 is H, residue at position 387 is S, residue at position 387 is T, residue at position 387 is A, residue at position 389 is P, residue at position 389 is S, residue at position 389 is N, residue at position 428 is L, residue at position 433 is K, residue at position 433 is R, residue at position 433 is S, residue at position 433 is I, residue at position 433 is P, residue at position 433 is Q, residue at position 434 is F, residue at position 434 is H, residue at position 434 is Y, residue at position 434 is A, residue at position 434 is S, residue at position 435 is A, residue at position 436 is H, residue at position 436 is I or residue at position 436 is V.

More suitably, the heavy chain constant region comprises mutations at positions 252, 254 and 256; 428 and 434; 433, 434 and 436; 428, 434 and 436; 252, 254, 256 and 322; and 309, 311 and 434; or functional variants thereof. More suitably, the heavy chain constant region comprises mutations at positions 252, 254 and 256; 428 and 434; 433, 434 and 436; 428, 434 and 436; 252, 254, 256 and 322; and 309, 311 and 434. Most suitably, the heavy chain constant region comprises the mutations M252Y, S254T and T256E or mutations M428L and N434S. Alternatively the antibody could be PEGylated to increase half-life.

Alternatively, or in addition, the heavy chain constant region may comprise Fc silencing mutations. Suitably, the heavy chain constant region comprises the mutations L234A and L235A. More suitably, the heavy chain constant region comprises the mutations L234A, L235A and P331S (LAL-APS). Alternatively, the heavy chain constant region comprises the mutations L234A, L235A and P239G (LALA PG). Alternatively, the heavy chain constant region comprises the mutations L235A and G237A (LAGA).

Accordingly, in certain embodiments the antibody may comprise the following combined heavy constant, heavy variable (VH), light constant and light variable (VL) polypeptide sequences in the antibody combinations 1 to 680 shown in Table 2. Suitably, the antibody comprises two heavy chains and two light chains, wherein each heavy chain comprises (e.g. consists of) the heavy constant and heavy variable (VH) sequences of one antibody combination of Table 2, and each light chain comprises (e.g. consists of) the light constant and light variable (VL) sequences of said antibody combination of Table 2.

TABLE 2

| Antibody combinations 1 to 680 comprising heavy and light chain variable regions and constant regions | | | | |
|---|---|---|---|---|
| Mutations | Com-bi-nation | Heavy constant SEQ ID NO: | Light constant SEQ ID NO: | VH SEQ ID NO: | VL SEQ ID NO: |
| Wild type | 1 | 1375 | 57 | 37 | 38 |
| | 2 | 1375 | 57 | 36 | 38 |
| | 3 | 1375 | 57 | 102 | 99 |
| | 4 | 1375 | 57 | 102 | 104 |
| | 5 | 1375 | 57 | 36 | 99 |
| L234A and | 6 | 1235 | 57 | 37 | 38 |
| L235A (LALA) | 7 | 1235 | 57 | 36 | 38 |
| | 8 | 1235 | 57 | 102 | 99 |
| | 9 | 1235 | 57 | 102 | 104 |
| | 10 | 1235 | 57 | 36 | 99 |
| L234A, L235A | 11 | 56 | 57 | 37 | 38 |
| and P331S | 12 | 56 | 57 | 36 | 38 |
| (LALA PS) | 13 | 56 | 57 | 102 | 99 |
| | 14 | 56 | 57 | 102 | 104 |
| | 15 | 56 | 57 | 36 | 99 |
| L234A, L235A | 16 | 1376 | 57 | 37 | 38 |
| and P329G | 17 | 1376 | 57 | 36 | 38 |
| (LALA PG) | 18 | 1376 | 57 | 102 | 99 |
| | 19 | 1376 | 57 | 102 | 104 |
| | 20 | 1376 | 57 | 36 | 99 |
| L235A and | 21 | 1377 | 57 | 37 | 38 |
| G237A (LAGA) | 22 | 1377 | 57 | 36 | 38 |
| | 23 | 1377 | 57 | 102 | 99 |
| | 24 | 1377 | 57 | 102 | 104 |
| | 25 | 1377 | 57 | 36 | 99 |
| M252Y, S254T | 26 | 1237 | 57 | 37 | 38 |
| and T256E | 27 | 1237 | 57 | 36 | 38 |
| | 28 | 1237 | 57 | 102 | 99 |
| | 29 | 1237 | 57 | 102 | 104 |
| | 30 | 1237 | 57 | 36 | 99 |
| M252Y, S254T, | 31 | 1238 | 57 | 37 | 38 |
| T256E, LALA | 32 | 1238 | 57 | 36 | 38 |
| | 33 | 1238 | 57 | 102 | 99 |
| | 34 | 1238 | 57 | 102 | 104 |
| | 35 | 1238 | 57 | 36 | 99 |
| M252Y, S254T, | 36 | 1239 | 57 | 37 | 38 |
| T256E, LALA | 37 | 1239 | 57 | 36 | 38 |
| PS | 38 | 1239 | 57 | 102 | 99 |
| | 39 | 1239 | 57 | 102 | 104 |
| | 40 | 1239 | 57 | 36 | 99 |
| M252Y, S254T, | 41 | 1240 | 57 | 37 | 38 |
| T256E, LALA | 42 | 1240 | 57 | 36 | 38 |
| PG | 43 | 1240 | 57 | 102 | 99 |
| | 44 | 1240 | 57 | 102 | 104 |
| | 45 | 1240 | 57 | 36 | 99 |
| M252Y, S254T, | 46 | 1241 | 57 | 37 | 38 |
| T256E, LAGA | 47 | 1241 | 57 | 36 | 38 |
| | 48 | 1241 | 57 | 102 | 99 |
| | 49 | 1241 | 57 | 102 | 104 |
| | 50 | 1241 | 57 | 36 | 99 |
| H433K, N434F | 51 | 1242 | 57 | 37 | 38 |
| | 52 | 1242 | 57 | 36 | 38 |
| | 53 | 1242 | 57 | 102 | 99 |
| | 54 | 1242 | 57 | 102 | 104 |
| | 55 | 1242 | 57 | 36 | 99 |
| H433K, N434F, | 56 | 1243 | 57 | 37 | 38 |
| LALA | 57 | 1243 | 57 | 36 | 38 |
| | 58 | 1243 | 57 | 102 | 99 |
| | 59 | 1243 | 57 | 102 | 104 |
| | 60 | 1243 | 57 | 36 | 99 |
| H433K, N434F, | 61 | 1244 | 57 | 37 | 38 |
| LALA PS | 62 | 1244 | 57 | 36 | 38 |
| | 63 | 1244 | 57 | 102 | 99 |
| | 64 | 1244 | 57 | 102 | 104 |
| | 65 | 1244 | 57 | 36 | 99 |
| H433K, N434F, | 66 | 1245 | 57 | 37 | 38 |
| LALA PG | 67 | 1245 | 57 | 36 | 38 |
| | 68 | 1245 | 57 | 102 | 99 |
| | 69 | 1245 | 57 | 102 | 104 |
| | 70 | 1245 | 57 | 36 | 99 |

TABLE 2-continued

Antibody combinations 1 to 680 comprising heavy and light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
| H433K, N434F, LAGA | 71 | 1246 | 57 | 37 | 38 |
|  | 72 | 1246 | 57 | 36 | 38 |
|  | 73 | 1246 | 57 | 102 | 99 |
|  | 74 | 1246 | 57 | 102 | 104 |
|  | 75 | 1246 | 57 | 36 | 99 |
| H433K, N434F, Y436H | 76 | 1247 | 57 | 37 | 38 |
|  | 77 | 1247 | 57 | 36 | 38 |
|  | 78 | 1247 | 57 | 102 | 99 |
|  | 79 | 1247 | 57 | 102 | 104 |
|  | 80 | 1247 | 57 | 36 | 99 |
| H433K, N434F, Y436H, LALA | 81 | 1248 | 57 | 37 | 38 |
|  | 82 | 1248 | 57 | 36 | 38 |
|  | 83 | 1248 | 57 | 102 | 99 |
|  | 84 | 1248 | 57 | 102 | 104 |
|  | 85 | 1248 | 57 | 36 | 99 |
| H433K, N434F, Y436H, LALA PS | 86 | 1249 | 57 | 37 | 38 |
|  | 87 | 1249 | 57 | 36 | 38 |
|  | 88 | 1249 | 57 | 102 | 99 |
|  | 89 | 1249 | 57 | 102 | 104 |
|  | 90 | 1249 | 57 | 36 | 99 |
| H433K, N434F, Y436H, LALA PG | 91 | 1250 | 57 | 37 | 38 |
|  | 92 | 1250 | 57 | 36 | 38 |
|  | 93 | 1250 | 57 | 102 | 99 |
|  | 94 | 1250 | 57 | 102 | 104 |
|  | 95 | 1250 | 57 | 36 | 99 |
| H433K, N434F, Y436H, LAGA | 96 | 1251 | 57 | 37 | 38 |
|  | 97 | 1251 | 57 | 36 | 38 |
|  | 98 | 1251 | 57 | 102 | 99 |
|  | 99 | 1251 | 57 | 102 | 104 |
|  | 100 | 1251 | 57 | 36 | 99 |
| M252Y, S254T, T256E, H433K, N434F | 101 | 1252 | 57 | 37 | 38 |
|  | 102 | 1252 | 57 | 36 | 38 |
|  | 103 | 1252 | 57 | 102 | 99 |
|  | 104 | 1252 | 57 | 102 | 104 |
|  | 105 | 1252 | 57 | 36 | 99 |
| M252Y, S254T, T256E, H433K, N434F, LALA | 106 | 1253 | 57 | 37 | 38 |
|  | 107 | 1253 | 57 | 36 | 38 |
|  | 108 | 1253 | 57 | 102 | 99 |
|  | 109 | 1253 | 57 | 102 | 104 |
|  | 110 | 1253 | 57 | 36 | 99 |
| M252Y, S254T, T256E, H433K, N434F, LALA PS | 111 | 1254 | 57 | 37 | 38 |
|  | 112 | 1254 | 57 | 36 | 38 |
|  | 113 | 1254 | 57 | 102 | 99 |
|  | 114 | 1254 | 57 | 102 | 104 |
|  | 115 | 1254 | 57 | 36 | 99 |
| M252Y, S254T, T256E, H433K, N434F, LALA PG | 116 | 1255 | 57 | 37 | 38 |
|  | 117 | 1255 | 57 | 36 | 38 |
|  | 118 | 1255 | 57 | 102 | 99 |
|  | 119 | 1255 | 57 | 102 | 104 |
|  | 120 | 1255 | 57 | 36 | 99 |
| M252Y, S254T, T256E, H433K, N434F, LAGA | 121 | 1256 | 57 | 37 | 38 |
|  | 122 | 1256 | 57 | 36 | 38 |
|  | 123 | 1256 | 57 | 102 | 99 |
|  | 124 | 1256 | 57 | 102 | 104 |
|  | 125 | 1256 | 57 | 36 | 99 |
| M252Y, S254T, T256E, H433K, N434F, Y436H | 126 | 1257 | 57 | 37 | 38 |
|  | 127 | 1257 | 57 | 36 | 38 |
|  | 128 | 1257 | 57 | 102 | 99 |
|  | 129 | 1257 | 57 | 102 | 104 |
|  | 130 | 1257 | 57 | 36 | 99 |
| M252Y, S254T, T256E, H433K, N434F, Y436H, LALA | 131 | 1258 | 57 | 37 | 38 |
|  | 132 | 1258 | 57 | 36 | 38 |
|  | 133 | 1258 | 57 | 102 | 99 |
|  | 134 | 1258 | 57 | 102 | 104 |
|  | 135 | 1258 | 57 | 36 | 99 |
| M252Y, S254T, T256E, H433K, N434F, Y436H, LALA PS | 136 | 1259 | 57 | 37 | 38 |
|  | 137 | 1259 | 57 | 36 | 38 |
|  | 138 | 1259 | 57 | 102 | 99 |
|  | 139 | 1259 | 57 | 102 | 104 |
|  | 140 | 1259 | 57 | 36 | 99 |
| M252Y, S254T, T256E, H433K, N434F, Y436H, LALA PG | 141 | 1260 | 57 | 37 | 38 |
|  | 142 | 1260 | 57 | 36 | 38 |
|  | 143 | 1260 | 57 | 102 | 99 |
|  | 144 | 1260 | 57 | 102 | 104 |
|  | 145 | 1260 | 57 | 36 | 99 |
| M252Y, S254T, T256E, H433K, N434F, Y436H, LAGA | 146 | 1261 | 57 | 37 | 38 |
|  | 147 | 1261 | 57 | 36 | 38 |
|  | 148 | 1261 | 57 | 102 | 99 |
|  | 149 | 1261 | 57 | 102 | 104 |
|  | 150 | 1261 | 57 | 36 | 99 |
| M428L, N434S | 151 | 1262 | 57 | 37 | 38 |
|  | 152 | 1262 | 57 | 36 | 38 |
|  | 153 | 1262 | 57 | 102 | 99 |
|  | 154 | 1262 | 57 | 102 | 104 |
|  | 155 | 1262 | 57 | 36 | 99 |
| M428L, N434S, LALA | 156 | 1263 | 57 | 37 | 38 |
|  | 157 | 1263 | 57 | 36 | 38 |
|  | 158 | 1263 | 57 | 102 | 99 |
|  | 159 | 1263 | 57 | 102 | 104 |
|  | 160 | 1263 | 57 | 36 | 99 |
| M428L, N434S, LALA PS | 161 | 1264 | 57 | 37 | 38 |
|  | 162 | 1264 | 57 | 36 | 38 |
|  | 163 | 1264 | 57 | 102 | 99 |
|  | 164 | 1264 | 57 | 102 | 104 |
|  | 165 | 1264 | 57 | 36 | 99 |
| M428L, N434S, LALA PG | 166 | 1265 | 57 | 37 | 38 |
|  | 167 | 1265 | 57 | 36 | 38 |
|  | 168 | 1265 | 57 | 102 | 99 |
|  | 169 | 1265 | 57 | 102 | 104 |
|  | 170 | 1265 | 57 | 36 | 99 |
| M428L, N434S, LAGA | 171 | 1266 | 57 | 37 | 38 |
|  | 172 | 1266 | 57 | 36 | 38 |
|  | 173 | 1266 | 57 | 102 | 99 |
|  | 174 | 1266 | 57 | 102 | 104 |
|  | 175 | 1266 | 57 | 36 | 99 |
| T250Q, M428L | 176 | 1267 | 57 | 37 | 38 |
|  | 177 | 1267 | 57 | 36 | 38 |
|  | 178 | 1267 | 57 | 102 | 99 |
|  | 179 | 1267 | 57 | 102 | 104 |
|  | 180 | 1267 | 57 | 36 | 99 |
| T250Q, M428L, LALA | 181 | 1268 | 57 | 37 | 38 |
|  | 182 | 1268 | 57 | 36 | 38 |
|  | 183 | 1268 | 57 | 102 | 99 |
|  | 184 | 1268 | 57 | 102 | 104 |
|  | 185 | 1268 | 57 | 36 | 99 |
| T250Q, M428L, LALA PS | 186 | 1269 | 57 | 37 | 38 |
|  | 187 | 1269 | 57 | 36 | 38 |
|  | 188 | 1269 | 57 | 102 | 99 |
|  | 189 | 1269 | 57 | 102 | 104 |
|  | 190 | 1269 | 57 | 36 | 99 |
| T250Q, M428L, LALA PG | 191 | 1270 | 57 | 37 | 38 |
|  | 192 | 1270 | 57 | 36 | 38 |
|  | 193 | 1270 | 57 | 102 | 99 |
|  | 194 | 1270 | 57 | 102 | 104 |
|  | 195 | 1270 | 57 | 36 | 99 |
| T250Q, M428L, LAGA | 196 | 1271 | 57 | 37 | 38 |
|  | 197 | 1271 | 57 | 36 | 38 |
|  | 198 | 1271 | 57 | 102 | 99 |
|  | 199 | 1271 | 57 | 102 | 104 |
|  | 200 | 1271 | 57 | 36 | 99 |
| T307A, E380A, N434A | 201 | 1272 | 57 | 37 | 38 |
|  | 202 | 1272 | 57 | 36 | 38 |
|  | 203 | 1272 | 57 | 102 | 99 |
|  | 204 | 1272 | 57 | 102 | 104 |
|  | 205 | 1272 | 57 | 36 | 99 |
| T307A, E380A, N434A, LALA | 206 | 1273 | 57 | 37 | 38 |
|  | 207 | 1273 | 57 | 36 | 38 |
|  | 208 | 1273 | 57 | 102 | 99 |
|  | 209 | 1273 | 57 | 102 | 104 |
|  | 210 | 1273 | 57 | 36 | 99 |
| T307A, E380A, N434A, LALA | 211 | 1274 | 57 | 37 | 38 |
|  | 212 | 1274 | 57 | 36 | 38 |

TABLE 2-continued

Antibody combinations 1 to 680 comprising heavy and light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
| PS | 213 | 1274 | 57 | 102 | 99 |
| | 214 | 1274 | 57 | 102 | 104 |
| | 215 | 1274 | 57 | 36 | 99 |
| T307A, E380A, N434A, LALA PG | 216 | 1275 | 57 | 37 | 38 |
| | 217 | 1275 | 57 | 36 | 38 |
| | 218 | 1275 | 57 | 102 | 99 |
| | 219 | 1275 | 57 | 102 | 104 |
| | 220 | 1275 | 57 | 36 | 99 |
| T307A, E380A, N434A, LAGA | 221 | 1276 | 57 | 37 | 38 |
| | 222 | 1276 | 57 | 36 | 38 |
| | 223 | 1276 | 57 | 102 | 99 |
| | 224 | 1276 | 57 | 102 | 104 |
| | 225 | 1276 | 57 | 36 | 99 |
| V308P | 226 | 1277 | 57 | 37 | 38 |
| | 227 | 1277 | 57 | 36 | 38 |
| | 228 | 1277 | 57 | 102 | 99 |
| | 229 | 1277 | 57 | 102 | 104 |
| | 230 | 1277 | 57 | 36 | 99 |
| V308P, LALA | 231 | 1278 | 57 | 37 | 38 |
| | 232 | 1278 | 57 | 36 | 38 |
| | 233 | 1278 | 57 | 102 | 99 |
| | 234 | 1278 | 57 | 102 | 104 |
| | 235 | 1278 | 57 | 36 | 99 |
| V308P, LALA PS | 236 | 1279 | 57 | 37 | 38 |
| | 237 | 1279 | 57 | 36 | 38 |
| | 238 | 1279 | 57 | 102 | 99 |
| | 239 | 1279 | 57 | 102 | 104 |
| | 240 | 1279 | 57 | 36 | 99 |
| V308P, LALA PG | 241 | 1280 | 57 | 37 | 38 |
| | 242 | 1280 | 57 | 36 | 38 |
| | 243 | 1280 | 57 | 102 | 99 |
| | 244 | 1280 | 57 | 102 | 104 |
| | 245 | 1280 | 57 | 36 | 99 |
| V308P, LAGA | 246 | 1281 | 57 | 37 | 38 |
| | 247 | 1281 | 57 | 36 | 38 |
| | 248 | 1281 | 57 | 102 | 99 |
| | 249 | 1281 | 57 | 102 | 104 |
| | 250 | 1281 | 57 | 36 | 99 |
| H285D, T307Q, A378V | 251 | 1282 | 57 | 37 | 38 |
| | 252 | 1282 | 57 | 36 | 38 |
| | 253 | 1282 | 57 | 102 | 99 |
| | 254 | 1282 | 57 | 102 | 104 |
| | 255 | 1282 | 57 | 36 | 99 |
| H285D, T307Q, A378V, LALA | 256 | 1283 | 57 | 37 | 38 |
| | 257 | 1283 | 57 | 36 | 38 |
| | 258 | 1283 | 57 | 102 | 99 |
| | 259 | 1283 | 57 | 102 | 104 |
| | 260 | 1283 | 57 | 36 | 99 |
| H285D, T307Q, A378V, LALA PS | 261 | 1284 | 57 | 37 | 38 |
| | 262 | 1284 | 57 | 36 | 38 |
| | 263 | 1284 | 57 | 102 | 99 |
| | 264 | 1284 | 57 | 102 | 104 |
| | 265 | 1284 | 57 | 36 | 99 |
| H285D, T307Q, A378V, LALA PG | 266 | 1285 | 57 | 37 | 38 |
| | 267 | 1285 | 57 | 36 | 38 |
| | 268 | 1285 | 57 | 102 | 99 |
| | 269 | 1285 | 57 | 102 | 104 |
| | 270 | 1285 | 57 | 36 | 99 |
| H285D, T307Q, A378V, LAGA | 271 | 1286 | 57 | 37 | 38 |
| | 272 | 1286 | 57 | 36 | 38 |
| | 273 | 1286 | 57 | 102 | 99 |
| | 274 | 1286 | 57 | 102 | 104 |
| | 275 | 1286 | 57 | 36 | 99 |
| L309D, Q311H, N434S | 276 | 1287 | 57 | 37 | 38 |
| | 277 | 1287 | 57 | 36 | 38 |
| | 278 | 1287 | 57 | 102 | 99 |
| | 279 | 1287 | 57 | 102 | 104 |
| | 280 | 1287 | 57 | 36 | 99 |
| L309D, Q311H, N434S, LALA | 281 | 1288 | 57 | 37 | 38 |
| | 282 | 1288 | 57 | 36 | 38 |
| | 283 | 1288 | 57 | 102 | 99 |
| | 284 | 1288 | 57 | 102 | 104 |
| | 285 | 1288 | 57 | 36 | 99 |
| L309D, Q311H, N434S, LALA PS | 286 | 1289 | 57 | 37 | 38 |
| | 287 | 1289 | 57 | 36 | 38 |
| | 288 | 1289 | 57 | 102 | 99 |
| | 289 | 1289 | 57 | 102 | 104 |
| | 290 | 1289 | 57 | 36 | 99 |
| L309D, Q311H, N434S, LALA PG | 291 | 1290 | 57 | 37 | 38 |
| | 292 | 1290 | 57 | 36 | 38 |
| | 293 | 1290 | 57 | 102 | 99 |
| | 294 | 1290 | 57 | 102 | 104 |
| | 295 | 1290 | 57 | 36 | 99 |
| L309D, Q311H, N434S, LAGA | 296 | 1291 | 57 | 37 | 38 |
| | 297 | 1291 | 57 | 36 | 38 |
| | 298 | 1291 | 57 | 102 | 99 |
| | 299 | 1291 | 57 | 102 | 104 |
| | 300 | 1291 | 57 | 36 | 99 |
| I253A, H310A, H435A | 301 | 1292 | 57 | 37 | 38 |
| | 302 | 1292 | 57 | 36 | 38 |
| | 303 | 1292 | 57 | 102 | 99 |
| | 304 | 1292 | 57 | 102 | 104 |
| | 305 | 1292 | 57 | 36 | 99 |
| I253A, H310A, H435A, LALA | 306 | 1293 | 57 | 37 | 38 |
| | 307 | 1293 | 57 | 36 | 38 |
| | 308 | 1293 | 57 | 102 | 99 |
| | 309 | 1293 | 57 | 102 | 104 |
| | 310 | 1293 | 57 | 36 | 99 |
| I253A, H310A, H435A, LALA PS | 311 | 1294 | 57 | 37 | 38 |
| | 312 | 1294 | 57 | 36 | 38 |
| | 313 | 1294 | 57 | 102 | 99 |
| | 314 | 1294 | 57 | 102 | 104 |
| | 315 | 1294 | 57 | 36 | 99 |
| I253A, H310A, H435A, LALA PG | 316 | 1295 | 57 | 37 | 38 |
| | 317 | 1295 | 57 | 36 | 38 |
| | 318 | 1295 | 57 | 102 | 99 |
| | 319 | 1295 | 57 | 102 | 104 |
| | 320 | 1295 | 57 | 36 | 99 |
| I253A, H310A, H435A, LAGA | 321 | 1296 | 57 | 37 | 38 |
| | 322 | 1296 | 57 | 36 | 38 |
| | 323 | 1296 | 57 | 102 | 99 |
| | 324 | 1296 | 57 | 102 | 104 |
| | 325 | 1296 | 57 | 36 | 99 |
| N434S, Q311I | 326 | 1297 | 57 | 37 | 38 |
| | 327 | 1297 | 57 | 36 | 38 |
| | 328 | 1297 | 57 | 102 | 99 |
| | 329 | 1297 | 57 | 102 | 104 |
| | 330 | 1297 | 57 | 36 | 99 |
| N434S, Q311I, LALA | 331 | 1298 | 57 | 37 | 38 |
| | 332 | 1298 | 57 | 36 | 38 |
| | 333 | 1298 | 57 | 102 | 99 |
| | 334 | 1298 | 57 | 102 | 104 |
| | 335 | 1298 | 57 | 36 | 99 |
| N434S, Q311I, LALA PS | 336 | 1299 | 57 | 37 | 38 |
| | 337 | 1299 | 57 | 36 | 38 |
| | 338 | 1299 | 57 | 102 | 99 |
| | 339 | 1299 | 57 | 102 | 104 |
| | 340 | 1299 | 57 | 36 | 99 |
| N434S, Q311I, LALA PG | 341 | 1300 | 57 | 37 | 38 |
| | 342 | 1300 | 57 | 36 | 38 |
| | 343 | 1300 | 57 | 102 | 99 |
| | 344 | 1300 | 57 | 102 | 104 |
| | 345 | 1300 | 57 | 36 | 99 |
| N434S, Q311I, LAGA | 346 | 1301 | 57 | 37 | 38 |
| | 347 | 1301 | 57 | 36 | 38 |
| | 348 | 1301 | 57 | 102 | 99 |
| | 349 | 1301 | 57 | 102 | 104 |
| | 350 | 1301 | 57 | 36 | 99 |
| N434S, Q311V | 351 | 1302 | 57 | 37 | 38 |
| | 352 | 1302 | 57 | 36 | 38 |
| | 353 | 1302 | 57 | 102 | 99 |

37

TABLE 2-continued

Antibody combinations 1 to 680 comprising heavy and light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
| | 354 | 1302 | 57 | 102 | 104 |
| | 355 | 1302 | 57 | 36 | 99 |
| N434S, Q311V, LALA | 356 | 1303 | 57 | 37 | 38 |
| | 357 | 1303 | 57 | 36 | 38 |
| | 358 | 1303 | 57 | 102 | 99 |
| | 359 | 1303 | 57 | 102 | 104 |
| | 360 | 1303 | 57 | 36 | 99 |
| N434S, Q311V, LALA PS | 361 | 1304 | 57 | 37 | 38 |
| | 362 | 1304 | 57 | 36 | 38 |
| | 363 | 1304 | 57 | 102 | 99 |
| | 364 | 1304 | 57 | 102 | 104 |
| | 365 | 1304 | 57 | 36 | 99 |
| N434S, Q311V, LALA PG | 366 | 1305 | 57 | 37 | 38 |
| | 367 | 1305 | 57 | 36 | 38 |
| | 368 | 1305 | 57 | 102 | 99 |
| | 369 | 1305 | 57 | 102 | 104 |
| | 370 | 1305 | 57 | 36 | 99 |
| N434S, Q311V, LAGA | 371 | 1306 | 57 | 37 | 38 |
| | 372 | 1306 | 57 | 36 | 38 |
| | 373 | 1306 | 57 | 102 | 99 |
| | 374 | 1306 | 57 | 102 | 104 |
| | 375 | 1306 | 57 | 36 | 99 |
| N434S, Y436I | 376 | 1307 | 57 | 37 | 38 |
| | 377 | 1307 | 57 | 36 | 38 |
| | 378 | 1307 | 57 | 102 | 99 |
| | 379 | 1307 | 57 | 102 | 104 |
| | 380 | 1307 | 57 | 36 | 99 |
| N434S, Y436I, LALA | 381 | 1308 | 57 | 37 | 38 |
| | 382 | 1308 | 57 | 36 | 38 |
| | 383 | 1308 | 57 | 102 | 99 |
| | 384 | 1308 | 57 | 102 | 104 |
| | 385 | 1308 | 57 | 36 | 99 |
| N434S, Y436I, LALA PS | 386 | 1309 | 57 | 37 | 38 |
| | 387 | 1309 | 57 | 36 | 38 |
| | 388 | 1309 | 57 | 102 | 99 |
| | 389 | 1309 | 57 | 102 | 104 |
| | 390 | 1309 | 57 | 36 | 99 |
| N434S, Y436I, LALA PG | 391 | 1310 | 57 | 37 | 38 |
| | 392 | 1310 | 57 | 36 | 38 |
| | 393 | 1310 | 57 | 102 | 99 |
| | 394 | 1310 | 57 | 102 | 104 |
| | 395 | 1310 | 57 | 36 | 99 |
| N434S, Y436I, LAGA | 396 | 1311 | 57 | 37 | 38 |
| | 397 | 1311 | 57 | 36 | 38 |
| | 398 | 1311 | 57 | 102 | 99 |
| | 399 | 1311 | 57 | 102 | 104 |
| | 400 | 1311 | 57 | 36 | 99 |
| N434S, Y436V | 401 | 1312 | 57 | 37 | 38 |
| | 402 | 1312 | 57 | 36 | 38 |
| | 403 | 1312 | 57 | 102 | 99 |
| | 404 | 1312 | 57 | 102 | 104 |
| | 405 | 1312 | 57 | 36 | 99 |
| N434S, Y436V, LALA | 406 | 1313 | 57 | 37 | 38 |
| | 407 | 1313 | 57 | 36 | 38 |
| | 408 | 1313 | 57 | 102 | 99 |
| | 409 | 1313 | 57 | 102 | 104 |
| | 410 | 1313 | 57 | 36 | 99 |
| N434S, Y436V, LALA PS | 411 | 1314 | 57 | 37 | 38 |
| | 412 | 1314 | 57 | 36 | 38 |
| | 413 | 1314 | 57 | 102 | 99 |
| | 414 | 1314 | 57 | 102 | 104 |
| | 415 | 1314 | 57 | 36 | 99 |
| N434S, Y436V, LALA PG | 416 | 1315 | 57 | 37 | 38 |
| | 417 | 1315 | 57 | 36 | 38 |
| | 418 | 1315 | 57 | 102 | 99 |
| | 419 | 1315 | 57 | 102 | 104 |
| | 420 | 1315 | 57 | 36 | 99 |
| N434S, Y436V, LAGA | 421 | 1316 | 57 | 37 | 38 |
| | 422 | 1316 | 57 | 36 | 38 |
| | 423 | 1316 | 57 | 102 | 99 |

38

TABLE 2-continued

Antibody combinations 1 to 680 comprising heavy and light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
| | 424 | 1316 | 57 | 102 | 104 |
| | 425 | 1316 | 57 | 36 | 99 |
| N434A | 426 | 1317 | 57 | 37 | 38 |
| | 427 | 1317 | 57 | 36 | 38 |
| | 428 | 1317 | 57 | 102 | 99 |
| | 429 | 1317 | 57 | 102 | 104 |
| | 430 | 1317 | 57 | 36 | 99 |
| N434A, LALA | 431 | 1318 | 57 | 37 | 38 |
| | 432 | 1318 | 57 | 36 | 38 |
| | 433 | 1318 | 57 | 102 | 99 |
| | 434 | 1318 | 57 | 102 | 104 |
| | 435 | 1318 | 57 | 36 | 99 |
| N434A, LALA PS | 436 | 1319 | 57 | 37 | 38 |
| | 437 | 1319 | 57 | 36 | 38 |
| | 438 | 1319 | 57 | 102 | 99 |
| | 439 | 1319 | 57 | 102 | 104 |
| | 440 | 1319 | 57 | 36 | 99 |
| N434A, LALA PG | 441 | 1320 | 57 | 37 | 38 |
| | 442 | 1320 | 57 | 36 | 38 |
| | 443 | 1320 | 57 | 102 | 99 |
| | 444 | 1320 | 57 | 102 | 104 |
| | 445 | 1320 | 57 | 36 | 99 |
| N434A, LAGA | 446 | 1321 | 57 | 37 | 38 |
| | 447 | 1321 | 57 | 36 | 38 |
| | 448 | 1321 | 57 | 102 | 99 |
| | 449 | 1321 | 57 | 102 | 104 |
| | 450 | 1321 | 57 | 36 | 99 |
| M252Y, V308P, N434Y | 451 | 1322 | 57 | 37 | 38 |
| | 452 | 1322 | 57 | 36 | 38 |
| | 453 | 1322 | 57 | 102 | 99 |
| | 454 | 1322 | 57 | 102 | 104 |
| | 455 | 1322 | 57 | 36 | 99 |
| M252Y, V308P, N434Y, LALA | 456 | 1323 | 57 | 37 | 38 |
| | 457 | 1323 | 57 | 36 | 38 |
| | 458 | 1323 | 57 | 102 | 99 |
| | 459 | 1323 | 57 | 102 | 104 |
| | 460 | 1323 | 57 | 36 | 99 |
| M252Y, V308P, N434Y, LALA PS | 461 | 1324 | 57 | 37 | 38 |
| | 462 | 1324 | 57 | 36 | 38 |
| | 463 | 1324 | 57 | 102 | 99 |
| | 464 | 1324 | 57 | 102 | 104 |
| | 465 | 1324 | 57 | 36 | 99 |
| M252Y, V308P, N434Y, LALA PG | 466 | 1325 | 57 | 37 | 38 |
| | 467 | 1325 | 57 | 36 | 38 |
| | 468 | 1325 | 57 | 102 | 99 |
| | 469 | 1325 | 57 | 102 | 104 |
| | 470 | 1325 | 57 | 36 | 99 |
| M252Y, V308P, N434Y, LAGA | 471 | 1326 | 57 | 37 | 38 |
| | 472 | 1326 | 57 | 36 | 38 |
| | 473 | 1326 | 57 | 102 | 99 |
| | 474 | 1326 | 57 | 102 | 104 |
| | 475 | 1326 | 57 | 36 | 99 |
| L234F, L235Q, K322Q, M252Y, S254T, T256E | 476 | 1327 | 57 | 37 | 38 |
| | 477 | 1327 | 57 | 36 | 38 |
| | 478 | 1327 | 57 | 102 | 99 |
| | 479 | 1327 | 57 | 102 | 104 |
| | 480 | 1327 | 57 | 36 | 99 |
| E294delta/T307P/N434Y | 481 | 1328 | 57 | 37 | 38 |
| | 482 | 1328 | 57 | 36 | 38 |
| | 483 | 1328 | 57 | 102 | 99 |
| | 484 | 1328 | 57 | 102 | 104 |
| | 485 | 1328 | 57 | 36 | 99 |
| E294delta/T307P/N434Y, LALA | 486 | 1329 | 57 | 37 | 38 |
| | 487 | 1329 | 57 | 36 | 38 |
| | 488 | 1329 | 57 | 102 | 99 |
| | 489 | 1329 | 57 | 102 | 104 |
| | 490 | 1329 | 57 | 36 | 99 |
| E294delta/T307P/N434Y, LALA PS | 491 | 1330 | 57 | 37 | 38 |
| | 492 | 1330 | 57 | 36 | 38 |
| | 493 | 1330 | 57 | 102 | 99 |

TABLE 2-continued

Antibody combinations 1 to 680 comprising heavy and light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
| | 494 | 1330 | 57 | 102 | 104 |
| | 495 | 1330 | 57 | 36 | 99 |
| E294delta/T307 P/N434Y, LALA PG | 496 | 1331 | 57 | 37 | 38 |
| | 497 | 1331 | 57 | 36 | 38 |
| | 498 | 1331 | 57 | 102 | 99 |
| | 499 | 1331 | 57 | 102 | 104 |
| | 500 | 1331 | 57 | 36 | 99 |
| E294delta/T307 P/N434Y, LAGA | 501 | 1332 | 57 | 37 | 38 |
| | 502 | 1332 | 57 | 36 | 38 |
| | 503 | 1332 | 57 | 102 | 99 |
| | 504 | 1332 | 57 | 102 | 104 |
| | 505 | 1332 | 57 | 36 | 99 |
| T256N/A378V/S 383N/N434Y | 506 | 1333 | 57 | 37 | 38 |
| | 507 | 1333 | 57 | 36 | 38 |
| | 508 | 1333 | 57 | 102 | 99 |
| | 509 | 1333 | 57 | 102 | 104 |
| | 510 | 1333 | 57 | 36 | 99 |
| T256N/A378V/S 383N/N434Y, LALA | 511 | 1334 | 57 | 37 | 38 |
| | 512 | 1334 | 57 | 36 | 38 |
| | 513 | 1334 | 57 | 102 | 99 |
| | 514 | 1334 | 57 | 102 | 104 |
| | 515 | 1334 | 57 | 36 | 99 |
| T256N/A378V/S 383N/N434Y, LALA PS | 516 | 1335 | 57 | 37 | 38 |
| | 517 | 1335 | 57 | 36 | 38 |
| | 518 | 1335 | 57 | 102 | 99 |
| | 519 | 1335 | 57 | 102 | 104 |
| | 520 | 1335 | 57 | 36 | 99 |
| T256N/A378V/S 383N/N434Y, LALA PG | 521 | 1336 | 57 | 37 | 38 |
| | 522 | 1336 | 57 | 36 | 38 |
| | 523 | 1336 | 57 | 102 | 99 |
| | 524 | 1336 | 57 | 102 | 104 |
| | 525 | 1336 | 57 | 36 | 99 |
| T256N/A378V/S 383N/N434Y, LAGA | 526 | 1337 | 57 | 37 | 38 |
| | 527 | 1337 | 57 | 36 | 38 |
| | 528 | 1337 | 57 | 102 | 99 |
| | 529 | 1337 | 57 | 102 | 104 |
| | 530 | 1337 | 57 | 36 | 99 |
| E294delta | 531 | 1338 | 57 | 37 | 38 |
| | 532 | 1338 | 57 | 36 | 38 |
| | 533 | 1338 | 57 | 102 | 99 |
| | 534 | 1338 | 57 | 102 | 104 |
| | 535 | 1338 | 57 | 36 | 99 |
| E294delta LALA | 536 | 1339 | 57 | 37 | 38 |
| | 537 | 1339 | 57 | 36 | 38 |
| | 538 | 1339 | 57 | 102 | 99 |
| | 539 | 1339 | 57 | 102 | 104 |
| | 540 | 1339 | 57 | 36 | 99 |
| E294delta LALA PS | 541 | 1340 | 57 | 37 | 38 |
| | 542 | 1340 | 57 | 36 | 38 |
| | 543 | 1340 | 57 | 102 | 99 |
| | 544 | 1340 | 57 | 102 | 104 |
| | 545 | 1340 | 57 | 36 | 99 |
| E294delta LALA PG | 546 | 1341 | 57 | 37 | 38 |
| | 547 | 1341 | 57 | 36 | 38 |
| | 548 | 1341 | 57 | 102 | 99 |
| | 549 | 1341 | 57 | 102 | 104 |
| | 550 | 1341 | 57 | 36 | 99 |
| E294delta LAGA | 551 | 1342 | 57 | 37 | 38 |
| | 552 | 1342 | 57 | 36 | 38 |
| | 553 | 1342 | 57 | 102 | 99 |
| | 554 | 1342 | 57 | 102 | 104 |
| | 555 | 1342 | 57 | 36 | 99 |
| T256D/N286D/T 307R/Q311V/A3 78V | 556 | 1343 | 57 | 37 | 38 |
| | 557 | 1343 | 57 | 36 | 38 |
| | 558 | 1343 | 57 | 102 | 99 |
| | 559 | 1343 | 57 | 102 | 104 |
| | 560 | 1343 | 57 | 36 | 99 |
| T256D/N286D/T 307R/Q311V/A3 78V, LALA | 561 | 1344 | 57 | 37 | 38 |
| | 562 | 1344 | 57 | 36 | 38 |
| | 563 | 1344 | 57 | 102 | 99 |
| | 564 | 1344 | 57 | 102 | 104 |
| | 565 | 1344 | 57 | 36 | 99 |
| T256D/N286D/T 307R/Q311V/A3 78V, LALA PS | 566 | 1345 | 57 | 37 | 38 |
| | 567 | 1345 | 57 | 36 | 38 |
| | 568 | 1345 | 57 | 102 | 99 |
| | 569 | 1345 | 57 | 102 | 104 |
| | 570 | 1345 | 57 | 36 | 99 |
| T256D/N286D/T 307R/Q311V/A3 78V, LALA PG | 571 | 1346 | 57 | 37 | 38 |
| | 572 | 1346 | 57 | 36 | 38 |
| | 573 | 1346 | 57 | 102 | 99 |
| | 574 | 1346 | 57 | 102 | 104 |
| | 575 | 1346 | 57 | 36 | 99 |
| T256D/N286D/T 307R/Q311V/A3 78V, LAGA | 576 | 1347 | 57 | 37 | 38 |
| | 577 | 1347 | 57 | 36 | 38 |
| | 578 | 1347 | 57 | 102 | 99 |
| | 579 | 1347 | 57 | 102 | 104 |
| | 580 | 1347 | 57 | 36 | 99 |
| T256D/T307Q | 581 | 1348 | 57 | 37 | 38 |
| | 582 | 1348 | 57 | 36 | 38 |
| | 583 | 1348 | 57 | 102 | 99 |
| | 584 | 1348 | 57 | 102 | 104 |
| | 585 | 1348 | 57 | 36 | 99 |
| T256D/T307Q, LALA | 586 | 1349 | 57 | 37 | 38 |
| | 587 | 1349 | 57 | 36 | 38 |
| | 588 | 1349 | 57 | 102 | 99 |
| | 589 | 1349 | 57 | 102 | 104 |
| | 590 | 1349 | 57 | 36 | 99 |
| T256D/T307Q, LALA PS | 591 | 1350 | 57 | 37 | 38 |
| | 592 | 1350 | 57 | 36 | 38 |
| | 593 | 1350 | 57 | 102 | 99 |
| | 594 | 1350 | 57 | 102 | 104 |
| | 595 | 1350 | 57 | 36 | 99 |
| T256D/T307Q, LALA PG | 596 | 1351 | 57 | 37 | 38 |
| | 597 | 1351 | 57 | 36 | 38 |
| | 598 | 1351 | 57 | 102 | 99 |
| | 599 | 1351 | 57 | 102 | 104 |
| | 600 | 1351 | 57 | 36 | 99 |
| T256D/T307Q, LAGA | 601 | 1352 | 57 | 37 | 38 |
| | 602 | 1352 | 57 | 36 | 38 |
| | 603 | 1352 | 57 | 102 | 99 |
| | 604 | 1352 | 57 | 102 | 104 |
| | 605 | 1352 | 57 | 36 | 99 |
| T256D/T307W | 606 | 1353 | 57 | 37 | 38 |
| | 607 | 1353 | 57 | 36 | 38 |
| | 608 | 1353 | 57 | 102 | 99 |
| | 609 | 1353 | 57 | 102 | 104 |
| | 610 | 1353 | 57 | 36 | 99 |
| T256D/T307W LALA | 611 | 1354 | 57 | 37 | 38 |
| | 612 | 1354 | 57 | 36 | 38 |
| | 613 | 1354 | 57 | 102 | 99 |
| | 614 | 1354 | 57 | 102 | 104 |
| | 615 | 1354 | 57 | 36 | 99 |
| T256D/T307W LALA PS | 616 | 1355 | 57 | 37 | 38 |
| | 617 | 1355 | 57 | 36 | 38 |
| | 618 | 1355 | 57 | 102 | 99 |
| | 619 | 1355 | 57 | 102 | 104 |
| | 620 | 1355 | 57 | 36 | 99 |
| T256D/T307W LALA PG | 621 | 1356 | 57 | 37 | 38 |
| | 622 | 1356 | 57 | 36 | 38 |
| | 623 | 1356 | 57 | 102 | 99 |
| | 624 | 1356 | 57 | 102 | 104 |
| | 625 | 1356 | 57 | 36 | 99 |
| T256D/T307W LAGA | 626 | 1357 | 57 | 37 | 38 |
| | 627 | 1357 | 57 | 36 | 38 |
| | 628 | 1357 | 57 | 102 | 99 |
| | 629 | 1357 | 57 | 102 | 104 |
| | 630 | 1357 | 57 | 36 | 99 |
| M252Y/T256D | 631 | 1358 | 57 | 37 | 38 |
| | 632 | 1358 | 57 | 36 | 38 |
| | 633 | 1358 | 57 | 102 | 99 |

41

TABLE 2-continued

Antibody combinations 1 to 680 comprising heavy and
light chain variable regions and constant regions

| Mutations | Combination | Heavy constant SEQ ID NO: | Light constant SEQ ID NO: | VH SEQ ID NO: | VL SEQ ID NO: |
|---|---|---|---|---|---|
|  | 634 | 1358 | 57 | 102 | 104 |
|  | 635 | 1358 | 57 | 36 | 99 |
| M252Y/T256D, | 636 | 1359 | 57 | 37 | 38 |
| LALA | 637 | 1359 | 57 | 36 | 38 |
|  | 638 | 1359 | 57 | 102 | 99 |
|  | 639 | 1359 | 57 | 102 | 104 |
|  | 640 | 1359 | 57 | 36 | 99 |
| M252Y/T256D, | 641 | 1360 | 57 | 37 | 38 |
| LALA PS | 642 | 1360 | 57 | 36 | 38 |
|  | 643 | 1360 | 57 | 102 | 99 |
|  | 644 | 1360 | 57 | 102 | 104 |
|  | 645 | 1360 | 57 | 36 | 99 |
| M252Y/T256D, | 646 | 1361 | 57 | 37 | 38 |
| LALA PG | 647 | 1361 | 57 | 36 | 38 |
|  | 648 | 1361 | 57 | 102 | 99 |
|  | 649 | 1361 | 57 | 102 | 104 |
|  | 650 | 1361 | 57 | 36 | 99 |
| M252Y/T256D, | 651 | 1362 | 57 | 37 | 38 |
| LAGA | 652 | 1362 | 57 | 36 | 38 |
|  | 653 | 1362 | 57 | 102 | 99 |
|  | 654 | 1362 | 57 | 102 | 104 |
|  | 655 | 1362 | 57 | 36 | 99 |
| T307Q/Q311V/A | 656 | 1363 | 57 | 37 | 38 |
| 378V | 657 | 1363 | 57 | 36 | 38 |
|  | 658 | 1363 | 57 | 102 | 99 |
|  | 659 | 1363 | 57 | 102 | 104 |
|  | 660 | 1363 | 57 | 36 | 99 |
| T307Q/Q311V/A | 661 | 1364 | 57 | 37 | 38 |
| 378V, LALA | 662 | 1364 | 57 | 36 | 38 |
|  | 663 | 1364 | 57 | 102 | 99 |
|  | 664 | 1364 | 57 | 102 | 104 |
|  | 665 | 1364 | 57 | 36 | 99 |
| T307Q/Q311V/A | 666 | 1365 | 57 | 37 | 38 |
| 378V, LALA PS | 667 | 1365 | 57 | 36 | 38 |
|  | 668 | 1365 | 57 | 102 | 99 |
|  | 669 | 1365 | 57 | 102 | 104 |
|  | 670 | 1365 | 57 | 36 | 99 |
| T307Q/Q311V/A | 671 | 1366 | 57 | 37 | 38 |
| 378V, LALA PG | 672 | 1366 | 57 | 36 | 38 |
|  | 673 | 1366 | 57 | 102 | 99 |
|  | 674 | 1366 | 57 | 102 | 104 |
|  | 675 | 1366 | 57 | 36 | 99 |
| T307Q/Q311V/A | 676 | 1367 | 57 | 37 | 38 |
| 378V, LAGA | 677 | 1367 | 57 | 36 | 38 |
|  | 678 | 1367 | 57 | 102 | 99 |
|  | 679 | 1367 | 57 | 102 | 104 |
|  | 680 | 1367 | 57 | 36 | 99 |

In further embodiments the antibody may comprise the combined heavy constant, heavy variable (VH), light constant and light variable (VL) polypeptide sequences in combinations 1 to 25 as shown above in Table 2, but wherein the heavy chain constant region comprises one or more of the following residues:

residue at position 250 is Q, residue at position 252 is Y, residue at position 252 is F, residue at position 252 is W, residue at position 252 is T, residue at position 253 is A, residue at position 254 is T, residue at position 256 is E, residue at position 256 is S, residue at position 256 is R, residue at position 256 is Q, residue at position 256 is D, residue at position 259 is I, residue at position 285 is D, residue at position 285 is N, residue at position 286 is D, residue at position 294 is deleted, residue at position 307 is A, residue at position 307 is Q, residue at position 307 is P, residue at position 307 is R, residue at position 307 is W, residue at position 308 is P, residue at position 308 is F, residue at position 309 is P, residue at position 309 is D, residue at position 309 is N, residue at position 310 is A, residue at position 311 is S, residue at position 311 is I, residue at position 311 is V, residue at position 311 is H, residue at position 315 is D, residue at position 378 is V, residue at position 380 is A, residue at position 385 is R, residue at position 385 is D, residue at position 385 is S, residue at position 385 is T, residue at position 385 is H, residue at position 385 is K, residue at position 385 is A, residue at position 385 is G, residue at position 386 is T, residue at position 386 is P, residue at position 386 is D, residue at position 386 is S, residue at position 386 is K, residue at position 386 is R, residue at position 386 is I, residue at position 386 is M, residue at position 387 is R, residue at position 387 is P, residue at position 387 is H, residue at position 387 is S, residue at position 387 is T, residue at position 387 is A, residue at position 389 is P, residue at position 389 is S, residue at position 389 is N, residue at position 428 is L, residue at position 433 is K, residue at position 433 is R, residue at position 433 is S, residue at position 433 is I, residue at position 433 is P, residue at position 433 is Q, residue at position 434 is F, residue at position 434 is H, residue at position 434 is Y, residue at position 434 is A, residue at position 434 is S, residue at position 435 is A, residue at position 436 is H, residue at position 436 is I or residue at position 436 is V.

In one embodiment, the antibody or fragment thereof comprises a heavy chain polypeptide sequence from N-terminus to C-terminus of SEQ ID NO: 37 followed by SEQ ID NO: 1239 and a light chain polypeptide sequence from N-terminus to C-terminus of SEQ ID NO: 38 followed by SEQ ID NO: 57. In one embodiment, the antibody or fragment thereof comprises a heavy chain polypeptide sequence from N-terminus to C-terminus of SEQ ID NO: 36 followed by SEQ ID NO: 1239 and a light chain polypeptide sequence from N-terminus to C-terminus of SEQ ID NO: 38 followed by SEQ ID NO: 57. In one embodiment, the antibody or fragment thereof comprises a heavy chain polypeptide sequence from N-terminus to C-terminus of SEQ ID NO: 102 followed by SEQ ID NO: 1239 and a light chain polypeptide sequence from N-terminus to C-terminus of SEQ ID NO: 99 followed by SEQ ID NO: 57. In one embodiment, the antibody or fragment thereof comprises a heavy chain polypeptide sequence from N-terminus to C-terminus of SEQ ID NO: 102 followed by SEQ ID NO: 1239 and a light chain polypeptide sequence from N-terminus to C-terminus of SEQ ID NO: 104 followed by SEQ ID NO: 57. In one embodiment, the antibody or fragment thereof comprises a heavy chain polypeptide sequence from N-terminus to C-terminus of SEQ ID NO: 36 followed by SEQ ID NO: 1239 and a light chain polypeptide sequence from N-terminus to C-terminus of SEQ ID NO: 99 followed by SEQ ID NO: 57.

In one embodiment, the antibody or fragment thereof comprises a heavy chain polypeptide sequence from N-terminus to C-terminus of SEQ ID NO: 37 followed by SEQ ID NO: 1264 and a light chain polypeptide sequence from N-terminus to C-terminus of SEQ ID NO: 38 followed by SEQ ID NO: 57. In one embodiment, the antibody or fragment thereof comprises a heavy chain polypeptide sequence from N-terminus to C-terminus of SEQ ID NO: 36 followed by SEQ ID NO: 1264 and a light chain polypeptide sequence from N-terminus to C-terminus of SEQ ID NO: 38 followed by SEQ ID NO: 57. In one embodiment, the antibody or fragment thereof comprises a heavy chain polypeptide sequence from N-terminus to C-terminus of SEQ ID NO: 102 followed by SEQ ID NO: 1264 and a light chain polypeptide sequence from N-terminus to C-terminus of SEQ ID NO: 99 followed by SEQ ID NO: 57. In one embodiment, the antibody or fragment thereof comprises a heavy chain polypeptide sequence from N-terminus to C-terminus of SEQ ID NO: 102 followed by SEQ ID NO: 1264 and a light chain polypeptide sequence from N-terminus to C-terminus of SEQ ID NO: 104 followed by SEQ ID NO: 57. In one embodiment, the antibody or fragment thereof comprises a heavy chain polypeptide sequence from N-terminus to C-terminus of SEQ ID NO: 36 followed by SEQ ID NO: 1264 and a light chain polypeptide sequence from N-terminus to C-terminus of SEQ ID NO: 99 followed by SEQ ID NO: 57.

An anti-LPAR1 antibody described herein can, in some embodiments, comprise a variant human Fc constant region that binds to human neonatal Fc receptor (FcRn) with greater affinity than that of the native human Fc constant region from which the variant human Fc constant region was derived. For example, the Fc constant region can comprise one or more (e.g., two, three, four, five, six, seven, or eight or more) amino acid substitutions relative to the native human Fc constant region from which the variant human Fc constant region was derived. The substitutions can increase the binding affinity of an IgG antibody containing the variant Fc constant region to FcRn at pH 6.0, while maintaining the pH dependence of the interaction. See, e.g., Hinton et al. (2004) *J Biol Chem* 279:6213-6216 and Datta-Mannan et al. (2007) *Drug Metab Dispos* 35:1-9. Methods for testing whether one or more substitutions in the Fc constant region of an antibody increase the affinity of the Fc constant region for FcRn at pH 6.0 (while maintaining pH dependence of the interaction) are known in the art and exemplified in the working examples. See, e.g., Datta-Mannan et al. (2007) *J Biol Chem* 282(3):1709-1717; International Publication No. WO 98/23289; International Publication No. WO 97/34631; and U.S. Pat. No. 6,277,375, the disclosures of each of which are incorporated herein by reference in their entirety.

Substitutions that enhance the binding affinity of an antibody Fc constant region for FcRn are known in the art and include, e.g., (1) the M252Y/S254T/T256E triple substitution described by Dall'Acqua et al. (2006) *J Biol Chem* 281: 23514-23524; (2) the M428L or T250Q/M428L substitutions described in Hinton et al. (2004) *J Biol Chem* 279:6213-6216 and Hinton et al. (2006) *J Immunol* 176: 346-356; and (3) the N434A or T307/E380A/N434A substitutions described in Petkova et al. (2006) *Int Immunol* 18(12):1759-69. The additional substitution pairings: P257I/Q311I, P257I/N434H, and D376V/N434H are described in, e.g., Datta-Mannan et al. (2007) *J Biol Chem* 282(3):1709-1717, the disclosure of which is incorporated herein by reference in its entirety.

In some embodiments, the variant constant region has a substitution at EU amino acid residue 255 for valine. In some embodiments, the variant constant region has a substitution at EU amino acid residue 309 for asparagine. In some embodiments, the variant constant region has a substitution at EU amino acid residue 312 for isoleucine. In some embodiments, the variant constant region has a substitution at EU amino acid residue 386.

In some embodiments, the variant Fc constant region comprises no more than 30 (e.g., no more than 29, 28, 27, 26, 25, 24, 23, 22, 21, 20, 19, 18, 17, 16, 15, 14, 13, 12, 11, 10, nine, eight, seven, six, five, four, three, or two) amino acid substitutions, insertions, or deletions relative to the native constant region from which it was derived. In some embodiments, the variant Fc constant region comprises one or more amino acid substitutions selected from the group consisting of: M252Y, S254T, T256E, N434S, M428L, V259I, T250I, and V308F. In some embodiments, the variant human Fc constant region comprises a methionine at position 428 and an asparagine at position 434, each in EU numbering. In some embodiments, the variant Fc constant region comprises a 428L/434S double substitution as described in, e.g., U.S. Pat. No. 8,088,376.

In some embodiments, the variant constant region comprises a substitution at amino acid position 237, 238, 239, 248, 250, 252, 254, 255, 256, 257, 258, 265, 270, 286, 289, 297, 298, 303, 305, 307, 308, 309, 311, 312, 314, 315, 317, 325, 332, 334, 360, 376, 380, 382, 384, 385, 386, 387, 389, 424, 428, 433, 434, or 436 (EU numbering) relative to the native human Fc constant region. In some embodiments, the substitution is selected from the group consisting of: methionine for glycine at position 237; alanine for proline at position 238; lysine for serine at position 239; isoleucine for lysine at position 248; alanine, phenylalanine, isoleucine, methionine, glutamine, serine, valine, tryptophan, or tyrosine for threonine at position 250; phenylalanine, tryptophan, or tyrosine for methionine at position 252; threonine for serine at position 254; glutamic acid for arginine at position 255; aspartic acid, glutamic acid, or glutamine for threonine at position 256; alanine, glycine, isoleucine, leucine, methionine, asparagine, serine, threonine, or valine for proline at position 257; histidine for glutamic acid at position 258; alanine for aspartic acid at position 265; phenylalanine for aspartic acid at position 270; alanine, or glutamic acid for asparagine at position 286; histidine for threonine at position 289; alanine for asparagine at position 297; glycine for serine at position 298; alanine for valine at position 303; alanine for valine at position 305; alanine, aspartic acid, phenylalanine, glycine, histidine, isoleucine, lysine, leucine, methionine, asparagine, proline, glutamine, arginine, serine, valine, tryptophan, or tyrosine for threonine at position 307; alanine, phenylalanine, isoleucine, leucine, methionine, proline, glutamine, or threonine for valine at position 308; alanine, aspartic acid, glutamic acid, proline, or arginine for leucine or valine at position 309; alanine, histidine, or isoleucine for glutamine at position 311; alanine or histidine for aspartic acid at position 312; lysine or arginine for leucine at position 314; alanine or histidine for asparagine at position 315; alanine for lysine at position 317; glycine for asparagine at position 325; valine for isoleucine at position 332; leucine for lysine at position 334; histidine for lysine at position 360; alanine for aspartic acid at position 376; alanine for glutamic acid at position 380; alanine for glutamic acid at position 382; alanine for asparagine or serine at position 384; aspartic acid or histidine for glycine at position 385; proline for glutamine at position 386; glutamic acid for proline at position 387; alanine or serine for asparagine at position 389; alanine for serine at position 424; alanine, aspartic acid, phenylalanine, glycine, histidine, isoleucine, lysine, leucine, asparagine, proline, glutamine, serine, threonine, valine, tryptophan, or tyrosine for methionine at position 428; lysine for histidine at position 433; alanine, phenylalanine, histidine, serine, tryptophan, or tyrosine for asparagine at position 434; and histidine for tyrosine or phenylalanine at position 436, all in EU numbering.

In one embodiment, the antibody or fragment thereof is a human antibody or fragment thereof. Thus, the antibody or fragment thereof may be derived from a human immunoglobulin (Ig) sequence. The CDR, framework and/or constant region of the antibody (or fragment thereof) may be derived from a human Ig sequence, in particular a human IgG sequence. The CDR, framework and/or constant region may be substantially identical for a human Ig sequence, in particular a human IgG sequence. An advantage of using human antibodies is that they have low or no immunogenicity in humans.

An antibody or fragment thereof can also be chimeric, for example a mouse-human antibody chimera.

Alternatively, the antibody or fragment thereof is derived from a non-human species, such as a mouse. Such non-human antibodies can be modified to increase their similarity to antibody variants produced naturally in humans, thus the antibody or fragment thereof can be partially or fully humanised. Therefore, in one embodiment, the antibody or fragment thereof is humanised. Suitably the antibody or fragment thereof is a human antibody or fragment thereof.

In one embodiment the antibody or fragment thereof may be a "functionally active variant" which also includes naturally occurring allelic variants, as well as mutants or any other non-naturally occurring variants. As is known in the art, an allelic variant is an alternate form of a (poly)peptide that is characterized as having a substitution, deletion, or addition of one or more amino acids that essentially does not alter the biological function of the polypeptide. By way of non-limiting example, said functionally active variants may still function when the frameworks containing the CDRs are modified, when the CDRs themselves are modified, when said CDRs are grafted to alternate frameworks, or when N- or C-terminal extensions are incorporated. Further, CDR-containing binding domains may be paired with differing partner chains such as those shared with another antibody. Upon sharing with so called 'common' light or 'common' heavy chains, said binding domains may still function. Further, said binding domains may function when multimerized.

Polypeptides Targeted to Epitopes

Provided herein are polypeptides which bind to an epitope of LPAR1. Binding of the epitope on LPAR1 in certain embodiments may have an effect on LPAR1 activity, such as preventing or reducing the rate of G proteins interacting with LPAR1, and thereby impacting inflammation, fibrosis, proliferation and migration of cells. The polypeptide may have a blocking effect by prevention of the binding or interaction of another antibody or molecule (e.g. LPA) or by stabilising a structure of LPAR1 that prevents downstream signalling (i.e. the blocking effect may not necessarily be by preventing the interaction of another molecule). Suitably the polypeptides of the invention are specific for LPAR1, and do not significantly bind to other antigens.

The present invention provides polypeptides which may bind to one or more of regions 30-44, 106-120, 190-204 and 280-294 of full length LPAR1 when using the numbering of UniProt Q92633 (SEQ ID NOs: 65-68, Example 6).

In one embodiment, the polypeptide may bind to one or more, such as two, three, four, five, six, seven, eight, nine, ten or more amino acid residues within the described regions.

The polypeptide does not need to bind to all amino acids within the defined range. For example, an antibody which binds to an epitope comprising amino acid residues within amino acid region 30-44 of SEQ ID NO: 62 (UniProt Q92633), may only bind with one or more of the amino acid residues in said range, e.g. the amino acid residues at each end of the range (i.e. amino acids 30 and 44), optionally including amino acids within the range (i.e. amino acids 32, 34, 36, 38 and 40).

Suitably the polypeptide binds to an epitope of LPAR1 comprising at least one of amino acids 30-44 of full length LPAR1 (SEQ ID NO: 62), such as comprising amino acids 35 and 36 of full length LPAR1 (SEQ ID NO: 62) and/or comprising amino acids 37 and 38 of full length LPAR1 (SEQ ID NO: 62) and/or comprising amino acids 32, 39, 40 and 41 of full length LPAR1 (SEQ ID NO: 62). Suitably the polypeptide binds to an epitope of LPAR1 comprising at least two, such as at least three, such as at least four, such as at least five, such as at least ten, such as all of amino acids 30-44 of full length LPAR1 (SEQ ID NO: 62).

Suitably the polypeptide binds to an epitope of LPAR1 comprising at least one of amino acids 106-120 of full length LPAR1 (SEQ ID NO: 62), such as comprising amino acid 114 of full length LPAR1 (SEQ ID NO: 62). Suitably the polypeptide binds to an epitope of LPAR1 comprising at least two, such as at least three, such as at least four, such as at least five, such as at least ten, such as all of amino acids 106-120 of full length LPAR1 (SEQ ID NO: 62).

Suitably the polypeptide binds to an epitope of LPAR1 comprising at least one of amino acids 190-204 of full length LPAR1 (SEQ ID NO: 62), such as comprising amino acid 193 of full length LPAR1 (SEQ ID NO: 62) and/or comprising amino acids 191, 192, 194 and 197 of full length LPAR1 (SEQ ID NO: 62) and/or comprising amino acid 190 of full length LPAR1 (SEQ ID NO: 62). Suitably the polypeptide binds to an epitope of LPAR1 comprising at least two, such as at least three, such as at least four, such as at least five, such as at least ten, such as all of amino acids 190-204 of full length LPAR1 (SEQ ID NO: 62).

Suitably the polypeptide binds to an epitope of LPAR1 comprising at least one of amino acids 280-294 of full length LPAR1 (SEQ ID NO: 62), such as comprising amino acid 286 of full length LPAR1 (SEQ ID NO: 62) and/or comprising amino acid 285 of full length LPAR1 (SEQ ID NO: 62). Suitably the polypeptide binds to an epitope of LPAR1 comprising at least two, such as at least three, such as at least four, such as at least five, such as at least ten, such as all of amino acids 280-294 of full length LPAR1 (SEQ ID NO: 62).

More suitably the polypeptide binds to an epitope of LPAR1 comprising or consisting of amino acids 30-44, 106-120, 190-204 and 280-294 of full length LPAR1 (SEQ ID NO: 62).

Suitably the polypeptide binds to an epitope of LPAR1 comprising residue 36 of full length LPAR1 (SEQ ID NO: 62). Suitably the polypeptide binds to an epitope of LPAR1 comprising residue 193 of full length LPAR1 (SEQ ID NO: 62). Suitably the polypeptide binds to an epitope of LPAR1 comprising residue 35 of full length LPAR1 (SEQ ID NO: 62). Suitably the polypeptide binds to an epitope of LPAR1 comprising residue 286 of LPAR1 (SEQ ID NO: 62).

Suitably the polypeptide binds to an epitope of LPAR1 comprising one or more of residues 36, 35, 193 or 286 of full length LPAR1 (SEQ ID NO: 62).

Suitably the polypeptide binds to a conformational epitope of human LPAR1 comprising one or more residues located within the N-terminal capping helix and one or more residues located within the extracellular domain 2. More suitably the polypeptide binds to an epitope of LPAR1 comprising residues 36 and 193 of full length LPAR1 (SEQ ID NO: 62).

In one embodiment there is provided a polypeptide wherein the polypeptide binds to the same, or essentially the same, epitope as, a polypeptide as defined herein.

In a further embodiment there is provided a polypeptide wherein the polypeptide competes with a polypeptide as defined herein for binding to LPAR1.

Polypeptide Sequences

The polypeptides of the invention may be described by reference to their CDR sequences.

Specific polypeptides provided by the present invention and their CDRs include the following:

TABLE 3

Specific HCDRs

| HCDR1 | HCDR2 | HCDR3 |
|---|---|---|
| SSGIS | EILPRSGYTNYNQGFTG | DFKGGRYAMDY |
| (12 HCDR1) | (12 HCDR2) | (12 HCDR3) |
| SEQ ID NO: 1 | SEQ ID NO: 2 | SEQ ID NO: 3 |
| SYGIS | EILPRSGYTNYNEKFKG | DFGSSRYAMDY |
| (02 HCDR1) | (01 HCDR2) | (01 HCDR3) |
| SEQ ID NO: 7 | SEQ ID NO: 8 | SEQ ID NO: 12 |
| RYWMS | EIYPRSGNTYYNEKFKG | DYGSSRYAMDY |
| (63D8 HCDR1) | (02 HCDR2) | (02 HCDR3) |
| SEQ ID NO: 107 | SEQ ID NO: 9 | SEQ ID NO: 13 |
| | EIYPRSGYTNYNEKFKG | DYDNSRYALDY |
| | (04 HCDR2) | (04 HCDR3) |
| | SEQ ID NO: 10 | SEQ ID NO: 14 |
| | EILPRSGYTNYNEGFTG | DKGPSRYTMDY |
| | (07 HCDR2) | (11 HCDR3) |
| | SEQ ID NO: 11 | SEQ ID NO: 15 |
| | EIQPRSGYTNYNQGFTG | DKGPARYTMDY |
| | (17 HCDR2) | (17 HCDR3) |
| | SEQ ID NO: 100 | SEQ ID NO: 101 |

TABLE 3-continued

Specific HCDRs

| | |
|---|---|
| EINPSRSAINYSPSLKD | QGQRLRYGMDY |
| (63D8 HCDR2) | (63D8 HCDR3) |
| SEQ ID NO: 108 | SEQ ID NO: 109 |

TABLE 4

Specific LCDRs

| LCDR1 | LCDR2 | LCDR3 |
|---|---|---|
| QASQSVRYNVA | YASNRYD (12 LCDR2) | QHHYSSPLTF (12 |
| (12 LCDR1) | SEQ ID NO: 5 | LCDR3) |
| SEQ ID NO: 4 | | SEQ ID NO: 6 |
| KASQSVRYNVA | YASNRYT (01 LCDR2) | QQHYNSPLTF |
| (01 LCDR1) | SEQ ID NO: 19 | (01 LCDR3) |
| SEQ ID NO: 16 | | SEQ ID NO: 20 |
| KASQSVGNNVA | YASNRYE (15 LCDR2) | QQHYSSPLTF |
| (02 LCDR1) | SEQ ID NO: 98 | (02 LCDR3) |
| SEQ ID NO: 17 | | SEQ ID NO: 21 |
| KASQSVGYNVA | WTSTRHT | QHHYNSPLTF |
| (04 LCDR1) | (63D8 LCDR2) | (05 LCDR3) |
| SEQ ID NO: 18 | SEQ ID NO: 111 | SEQ ID NO: 22 |
| QASQSIRYNVA | | QQHYGTPLT |
| (18 LCDR1) | | (63D8 LCDR3) |
| SEQ ID NO: 103 | | SEQ ID NO: 112 |
| RASQDVRTAVA | | |
| (63D8 LCDR1) | | |
| SEQ ID NO: 110 | | |

TABLE 5

Specific combinations of CDRs

| Antibody | HCDR1 | HCDR2 | HCDR3 | LCDR1 | LCDR2 | LCDR3 |
|---|---|---|---|---|---|---|
| Antibody 1 | 12 HCDR1 | 01 HCDR2 | 01 HCDR3 | 01 LCDR1 | 01 LCDR2 | 01 LCDR3 |
| | SEQ ID NO: 1 | SEQ ID NO: 8 | SEQ ID NO: 12 | SEQ ID NO: 16 | SEQ ID NO: 19 | SEQ ID NO: 20 |
| Antibody 2 | 02 HCDR1 | 02 HCDR2 | 02 HCDR3 | 02 LCDR1 | 01 LCDR2 | 02 LCDR3 |
| | SEQ ID NO: 7 | SEQ ID NO: 9 | SEQ ID NO: 13 | SEQ ID NO: 17 | SEQ ID NO: 19 | SEQ ID NO: 21 |
| Antibody 3 | 12 HCDR1 | 01 HCDR2 | 01 HCDR3 | 01 LCDR1 | 01 LCDR2 | 01 LCDR3 |
| (same combination | SEQ ID NO: 1 | SEQ ID NO: 8 | SEQ ID NO: 12 | SEQ ID NO: 16 | SEQ ID NO: 19 | SEQ ID NO: 20 |
| as Antibody 1) | | | | | | |
| Antibody 4 | 12 HCDR1 | 04 HCDR2 | 04 HCDR3 | 04 LCDR1 | 01 LCDR2 | 12 LCDR3 |
| | SEQ ID NO: 1 | SEQ ID NO: 10 | SEQ ID NO: 14 | SEQ ID NO: 18 | SEQ ID NO: 19 | SEQ ID NO: 6 |
| Antibody 5 | 12 HCDR1 | 01 HCDR2 | 01 HCDR3 | 01 LCDR1 | 01 LCDR2 | 05 LCDR3 |
| | SEQ ID NO: 1 | SEQ ID NO: 8 | SEQ ID NO: 12 | SEQ ID NO: 16 | SEQ ID NO: 19 | SEQ ID NO: 22 |
| Antibody 6 | 12 HCDR1 | 01 HCDR2 | 01 HCDR3 | 01 LCDR1 | 01 LCDR2 | 12 LCDR3 |
| | SEQ ID NO: 1 | SEQ ID NO: 8 | SEQ ID NO: 12 | SEQ ID NO: 16 | SEQ ID NO: 19 | SEQ ID NO: 6 |
| Antibody 7 | 12 HCDR1 | 07 HCDR2 | 01 HCDR3 | 12 LCDR1 | 01 LCDR2 | 01 LCDR3 |
| | SEQ ID NO: 1 | SEQ ID NO: 11 | SEQ ID NO: 12 | SEQ ID NO: 4 | SEQ ID NO: 19 | SEQ ID NO: 20 |
| Antibody 8 | 12 HCDR1 | 07 HCDR2 | 01 HCDR3 | 12 LCDR1 | 01 LCDR2 | 12 LCDR3 |
| | SEQ ID NO: 1 | SEQ ID NO: 11 | SEQ ID NO: 12 | SEQ ID NO: 4 | SEQ ID NO: 19 | SEQ ID NO: 6 |
| Antibody 9 | 12 HCDR1 | 12 HCDR2 | 01 HCDR3 | 12 LCDR1 | 01 LCDR2 | 12 LCDR3 |
| | SEQ ID NO: 1 | SEQ ID NO: 2 | SEQ ID NO: 12 | SEQ ID NO: 4 | SEQ ID NO: 19 | SEQ ID NO: 6 |
| Antibody 10 | 12 HCDR1 | 12 HCDR2 | 12 HCDR3 | 12 LCDR1 | 01 LCDR2 | 12 LCDR3 |
| | SEQ ID NO: 1 | SEQ ID NO: 2 | SEQ ID NO: 3 | SEQ ID NO: 4 | SEQ ID NO: 19 | SEQ ID NO: 6 |
| Antibody 11 | 12 HCDR1 | 12 HCDR2 | 11 HCDR3 | 12 LCDR1 | 01 LCDR2 | 12 LCDR3 |
| | SEQ ID NO: 1 | SEQ ID NO: 2 | SEQ ID NO: 15 | SEQ ID NO: 4 | SEQ ID NO: 19 | SEQ ID NO: 6 |
| Antibody 12 | 12 HCDR1 | 12 HCDR2 | 12 HCDR3 | 12 LCDR1 | 12 LCDR2 | 12 LCDR3 |
| | SEQ ID NO: 1 | SEQ ID NO: 2 | SEQ ID NO: 3 | SEQ ID NO: 4 | SEQ ID NO: 5 | SEQ ID NO: 6 |
| Antibody 13 | 12 HCDR1 | 12 HCDR2 | 11 HCDR3 | 12 LCDR1 | 12 LCDR2 | 12 LCDR3 |
| | SEQ ID NO: 1 | SEQ ID NO: 2 | SEQ ID NO: 15 | SEQ ID NO: 4 | SEQ ID NO: 5 | SEQ ID NO: 6 |
| Antibody 14 | 12 HCDR1 | 07 HCDR2 | 01 HCDR3 | 12 LCDR1 | 01 LCDR2 | 01 LCDR3 |
| (same combination | SEQ ID NO: 1 | SEQ ID NO: 11 | SEQ ID NO: 12 | SEQ ID NO: 4 | SEQ ID NO: 19 | SEQ ID NO: 20 |
| as Antibody 7) | | | | | | |

TABLE 5-continued

| Specific combinations of CDRs | | | | | |
|---|---|---|---|---|---|
| Antibody | HCDR1 | HCDR2 | HCDR3 | LCDR1 | LCDR2 | LCDR3 |
| Antibody 15 | 12 HCDR1 | 12 HCDR2 | 12 HCDR3 | 12 LCDR1 | 15 LCDR2 | 12 LCDR3 |
| | SEQ ID NO: 1 | SEQ ID NO: 2 | SEQ ID NO: 3 | SEQ ID NO: 4 | SEQ ID NO: 98 | SEQ ID NO: 6 |
| Antibody 16 | 12 HCDR1 | 12 HCDR2 | 12 HCDR3 | 12 LCDR1 | 15 LCDR2 | 12 LCDR3 |
| (same combination | SEQ ID NO: 1 | SEQ ID NO: 2 | SEQ ID NO: 3 | SEQ ID NO: 4 | SEQ ID NO: 98 | SEQ ID NO: 6 |
| as Antibody 15) | | | | | | |
| Antibody 17 | 12 HCDR1 | 17 HCDR2 | 17 HCDR3 | 12 LCDR1 | 15 LCDR2 | 12 LCDR3 |
| | SEQ ID NO: 1 | SEQ ID NO: 100 | SEQ ID NO: 101 | SEQ ID NO: 4 | SEQ ID NO: 98 | SEQ ID NO: 6 |
| Antibody 18 | 12 HCDR1 | 17 HCDR2 | 17 HCDR3 | 18 LCDR1 | 15 LCDR2 | 12 LCDR3 |
| | SEQ ID NO: 1 | SEQ ID NO: 100 | SEQ ID NO: 101 | SEQ ID NO: 103 | SEQ ID NO: 98 | SEQ ID NO: 6 |
| 63D8 | 63D8 HCDR1 | 63D8 HCDR2 | 63D8 HCDR3 | 63D8 LCDR1 | 63D8 LCDR2 | 63 D8 LCDR3 |
| | SEQ ID NO: 107 | SEQ ID NO: 108 | SEQ ID NO: 109 | SEQ ID NO: 110 | SEQ ID NO: 111 | SEQ ID NO: 112 |

The polypeptide may comprise three heavy chain CDRs (HCDR1-3). The polypeptide may comprise three light chain CDRs (LCDR1-3). Preferably, the polypeptide comprises three heavy chain CDRs (HCDR1-3) and three light chain CDRs (LCDR1-3).

The polypeptide may comprise a HCDR1 comprising a sequence having at least 40%, such as at least 60%, such as at least 80% identity with SEQ ID NO: 1 or SEQ ID NO: 7. The polypeptide may comprise a HCDR1 consisting of a sequence having at least 40%, such as at least 60%, such as at least 80% identity with SEQ ID NO: 1 or SEQ ID NO: 7. Suitably the polypeptide comprises a HCDR1 comprising SEQ ID NO: 1 or SEQ ID NO: 7. More suitably the polypeptide comprises a HCDR1 consisting of SEQ ID NO: 1 or SEQ ID NO: 7. More suitably the polypeptide comprises a HCDR1 comprising SEQ ID NO: 1, or more suitably consisting of SEQ ID NO: 1.

The polypeptide may comprise a HCDR2 comprising a sequence having at least 50%, such as at least 60%, such as at least 70%, such as at least 80%, such as at least 85%, such as at least 90% identity with any one of SEQ ID NOs: 2, 8 to 11 or 100. The polypeptide may comprise a HCDR2 consisting of a sequence having at least 50%, such as at least 60%, such as at least 70%, such as at least 80%, such as at least 85%, such as at least 90% identity with any one of SEQ ID NOs: 2, 8 to 11 or 100. Suitably the polypeptide comprises a HCDR2 comprising any one of SEQ ID NOs: 2, 8 to 11 or 100. More suitably, the polypeptide comprises a HCDR2 consisting of any one of SEQ ID NOs: 2, 8 to 11 or 100, such as a HCDR2 comprising SEQ ID NO: 2 or more suitably consisting of SEQ ID NO: 2.

The polypeptide may comprise a HCDR3 comprising a sequence having at least 60%, such as at least 70%, such as at least 80%, such as at least 90% identity with any one of SEQ ID NOs: 3, 12 to 15, or 101. The polypeptide may comprise a HCDR3 consisting of a sequence having at least 60%, such as at least 70%, such as at least 80%, such as at least 90% identity with any one of SEQ ID NOs: 3, 12 to 15, or 101. Suitably, the polypeptide comprises a HCDR3 comprising any one of SEQ ID NOs: 3, 12 to 15, or 101. More suitably the polypeptide comprises a HCDR3 consisting of any one of SEQ ID NOs: 3, 12 to 15, or 101. More suitably the polypeptide comprises a HCDR3 comprising SEQ ID NO: 3, such as a HCDR3 consisting of SEQ ID NO: 3. Alternatively, the polypeptide comprises a HCDR3 comprising SEQ ID NO: 15, such as consisting of SEQ ID NO: 15. Alternatively, the polypeptide comprises a HCDR3 comprising SEQ ID NO: 101, such as consisting of SEQ ID NO: 101.

The polypeptide may comprise a LCDR1 comprising a sequence having at least 60%, such as at least 70%, such as at least 80%, such as at least 90% identity with any one of SEQ ID NOs: 4, 16 to 18 or 103. The polypeptide may comprise a LCDR1 consisting of a sequence having at least 60%, such as at least 70%, such as at least 80%, such as at least 90% identity with any one of SEQ ID NOs: 4, 16 to 18 or 103. Suitably, the polypeptide comprises a LCDR1 comprising any one of SEQ ID NOs: 4, 16 to 18 or 103. More suitably, the polypeptide comprises a LCDR1 consisting of any one of SEQ ID NOs: 4, 16 to 18 or 103. More suitably the polypeptide comprises a LCDR1 comprising SEQ ID NO: 4, or more suitably consisting of SEQ ID NO: 4. More suitably the polypeptide comprises a LCDR1 comprising SEQ ID NO: 103, or more suitably consisting of SEQ ID NO: 103.

The polypeptide may comprise a LCDR2 comprising a sequence having at least 50% identity, such as at least 60%, such as at least 70%, such as at least 80% identity with SEQ ID NO: 5, 19 or 98. The polypeptide may comprise a LCDR2 consisting of a sequence having at least 50% identity, such as at least 60%, such as at least 70%, such as at least 80% identity with SEQ ID NO: 5, 19 or 98. Suitably the polypeptide comprises a LCDR2 comprising SEQ ID NO: 5, 19 or 98. More suitably the polypeptide comprises a LCDR2 consisting of SEQ ID NO: 5, 19 or 98. More suitably the polypeptide comprises a LCDR2 comprising SEQ ID NO: 5, more suitably consisting of SEQ ID NO: 5.

The polypeptide may comprise a LCDR3 comprising a sequence having at least 50%, such as at least 60%, such as at least 70%, such as at least 80% identity with any one of SEQ ID NOs: 6 or 20 to 22. The polypeptide may comprise a LCDR3 consisting of a sequence having at least 50%, such as at least 60%, such as at least 70%, such as at least 80% identity with any one of SEQ ID NOs: 6 or 20 to 22. More suitably the polypeptide comprises a LCDR3 comprising any one of SEQ ID NOs: 6 or 20 to 22. More suitably the polypeptide comprises a LCDR3 consisting of any one of SEQ ID NOs: 6 or 20 to 22, more suitably the polypeptide comprises a LCDR3 comprising SEQ ID NO: 6, more suitably consisting of SEQ ID NO: 6.

Alternatively, the polypeptide may comprise a HCDR1 comprising, such as consisting of, a sequence having at least 40%, such as at least 60%, such as at least 80%, such as 100% identity with SEQ ID NO: 107. Suitably the polypeptide comprises a HCDR2 comprising, such as consisting of, a sequence having at least 50%, such as at least 60%, such as at least 70%, such as at least 80%, such as at least 85%, such as at least 90%, such as 100% identity with SEQ ID NO: 108. Suitably the polypeptide comprises a HCDR3 comprising, such as consisting of, a sequence having at least 60%, such as at least 70%, such as at least 80%, such as at least 90%, such as 100% identity with SEQ ID NO: 109. Suitably the polypeptide comprises a LCDR1 comprising, such as consisting of, a sequence having at least 60%, such as at least 70%, such as at least 80%, such as at least 90% such as 100% identity with SEQ ID NO: 110. Suitably the polypeptide comprises a LCDR2 comprising, such as consisting of, a sequence having at least 50% identity, such as at least 60%, such as at least 70%, such as at least 80% identity, such as 100% identity with SEQ ID NO: 111. Suitably the polypeptide comprises a LCDR3 comprising, such as consisting of, a sequence having at least 50%, such as at least 60%, such as at least 70%, such as at least 80%, such as 100% identity with SEQ ID NO: 112.

In one embodiment, the polypeptide comprises (a) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 5 and a LCDR3 comprising SEQ ID NO: 6;

(b) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 20;

(c) a HCDR1 comprising SEQ ID NO: 7, a HCDR2 comprising SEQ ID NO: 9, a HCDR3 comprising SEQ ID NO: 13, a LCDR1 comprising SEQ ID NO: 17, a LCDR2 comprising SEQ ID NO: 19 and a LCDR3 comprising SEQ ID NO: 21;

(d) a HCDR1 comprising SEQ ID NO: 1, a HCDR2 comprising SEQ ID NO: 10, a HCDR3 comprising SEQ ID NO: 14, a LCDR1 comprising SEQ ID NO: 18, a LCDR2 comprising SEQ ID NO: 19 and a LCDR3 comprising SEQ ID NO: 6;

(e) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 22;

(f) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 6;

(g) a HCDR1 comprising SEQ ID NO: 1, a HCDR2 comprising SEQ ID NO: 11, a HCDR3 comprising SEQ ID NO: 12, a LCDR1 comprising SEQ ID NO: 4, a LCDR2 comprising SEQ ID NO: 19 and a LCDR3 comprising SEQ ID NO: 20;

(h) a HCDR1 comprising SEQ ID NO: 1, a HCDR2 comprising SEQ ID NO: 11, a HCDR3 comprising SEQ ID NO: 12, a LCDR1 comprising SEQ ID NO: 4, a LCDR2 comprising SEQ ID NO: 19 and a LCDR3 comprising SEQ ID NO: 6;

(i) a HCDR1 comprising SEQ ID NO: 1, a HCDR2 comprising SEQ ID NO: 2, a HCDR3 comprising SEQ ID NO: 12, a LCDR1 comprising SEQ ID NO: 4, a LCDR2 comprising SEQ ID NO: 19 and a LCDR3 comprising SEQ ID NO: 6;

(j) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 19 and a LCDR3 comprising SEQ ID NO: 6;

(k) a HCDR1 comprising SEQ ID NO: 1, a HCDR2 comprising SEQ ID NO: 2, a HCDR3 comprising SEQ ID NO: 15, a LCDR1 comprising SEQ ID NO: 4, a LCDR2 comprising SEQ ID NO: 19 and a LCDR3 comprising SEQ ID NO: 6;

(l) a HCDR1 comprising SEQ ID NO: 1, a HCDR2 comprising SEQ ID NO: 2, a HCDR3 comprising SEQ ID NO: 15, a LCDR1 comprising SEQ ID NO: 4, a LCDR2 comprising SEQ ID NO: 5 and a LCDR3 comprising SEQ ID NO: 6;

(m) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 98 and a LCDR3 comprising SEQ ID NO: 6;

(n) a HCDR1 comprising SEQ ID NO: 1, a HCDR2 comprising SEQ ID NO: 100, a HCDR3 comprising SEQ ID NO: 101, a LCDR1 comprising SEQ ID NO: 4, a LCDR2 comprising SEQ ID NO: 98 and a LCDR3 comprising SEQ ID NO: 6 or (o) a HCDR1 comprising SEQ ID NO: 1, a HCDR2 comprising SEQ ID NO: 100, a HCDR3 comprising SEQ ID NO: 101, a LCDR1 comprising SEQ ID NO: 103, a LCDR2 comprising SEQ ID NO: 98 and a LCDR3 comprising SEQ ID NO: 6.

More suitably, the polypeptide comprises (a) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 5 and a LCDR3 consisting of SEQ ID NO: 6;

(b) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 20;

(c) a HCDR1 consisting of SEQ ID NO: 7, a HCDR2 consisting of SEQ ID NO: 9, a HCDR3 consisting of SEQ ID NO: 13, a LCDR1 consisting of SEQ ID NO: 17, a LCDR2 consisting of SEQ ID NO: 19 and a LCDR3 consisting of SEQ ID NO: 21;

(d) a HCDR1 consisting of SEQ ID NO: 1, a HCDR2 consisting of SEQ ID NO: 10, a HCDR3 consisting of SEQ ID NO: 14, a LCDR1 consisting of SEQ ID NO: 18, a LCDR2 consisting of SEQ ID NO: 19 and a LCDR3 consisting of SEQ ID NO: 6;

(e) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 22;

(f) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 6;

(g) a HCDR1 consisting of SEQ ID NO: 1, a HCDR2 consisting of SEQ ID NO: 11, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 20;

(h) a HCDR1 consisting of SEQ ID NO: 1, a HCDR2 consisting of SEQ ID NO: 11, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 6;

(i) a HCDR1 consisting of SEQ ID NO: 1, a HCDR2 consisting of SEQ ID NO: 2, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 6;

(j) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 19 and a LCDR3 consisting of SEQ ID NO: 6;

(k) a HCDR1 consisting of SEQ ID NO: 1, a HCDR2 consisting of SEQ ID NO: 2, a HCDR3 consisting of SEQ ID NO: 15, a LCDR1 consisting of SEQ ID NO: 4, a LCDR2 consisting of SEQ ID NO: 19 and a LCDR3 consisting of SEQ ID NO: 6;

(l) a HCDR1 consisting of SEQ ID NO: 1, a HCDR2 consisting of SEQ ID NO: 2, a HCDR3 consisting of SEQ ID NO: 15, a LCDR1 consisting of SEQ ID NO: 4, a LCDR2 consisting of SEQ ID NO: 5 and a LCDR3 consisting of SEQ ID NO: 6;

(m) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 98 and a LCDR3 consisting of SEQ ID NO: 6;

(n) a HCDR1 consisting of SEQ ID NO: 1, a HCDR2 consisting of SEQ ID NO: 100, a HCDR3 consisting of SEQ ID NO: 101, a LCDR1 consisting of SEQ ID NO: 4, a LCDR2 consisting of SEQ ID NO: 98 and a LCDR3 consisting of SEQ ID NO: 6 or (o) a HCDR1 consisting of SEQ ID NO: 1, a HCDR2 consisting of SEQ ID NO: 100, a HCDR3 consisting of SEQ ID NO: 101, a LCDR1 consisting of SEQ ID NO: 103, a LCDR2 consisting of SEQ ID NO: 98 and a LCDR3 consisting of SEQ ID NO: 6.

The polypeptide may comprise four heavy chain framework regions (HFR1-HFR4).

The polypeptide may comprise a HFR1 comprising or consisting of a sequence having at least 50%, such as at least 60%, such as at least 70%, such as at least 80%, such as at least 90% identity with SEQ ID NO: 40, a HFR2 comprising or consisting of a sequence having at least 50%, such as at least 60%, such as at least 70%, such as at least 80%, such as at least 90% identity with SEQ ID NO: 41, a HFR3 comprising or consisting of a sequence having at least 50%, such as at least 60%, such as at least 70%, such as at least 80%, such as at least 90% identity with SEQ ID NO: 42 and/or a HFR4 comprising or consisting of a sequence having at least 50%, such as at least 60%, such as at least 70%, such as at least 80%, such as at least 90% identity with SEQ ID NO: 43. Suitably, the polypeptide comprises a HFR1 comprising SEQ ID NO: 40, a HFR2 comprising SEQ ID NO: 41, a HFR3 comprising SEQ ID NO: 42 and/or a HFR4 comprising SEQ ID NO: 43. More suitably, the polypeptide comprises a HFR1 consisting of SEQ ID NO: 40, a HFR2 consisting of SEQ ID NO: 41, a HFR3 consisting of SEQ ID NO: 42 and/or a HFR4 consisting of SEQ ID NO: 43.

Alternatively, the polypeptide may comprise a HFR1 comprising or consisting of a sequence having at least 50%, such as at least 60%, such as at least 70%, such as at least 80%, such as at least 90% identity with SEQ ID NO: 48, a HFR2 comprising or consisting of a sequence having at least 50%, such as at least 60%, such as at least 70%, such as at least 80%, such as at least 90% identity with SEQ ID NO: 49, a HFR3 comprising or consisting of a sequence having at least 50%, such as at least 60%, such as at least 70%, such as at least 80%, such as at least 90% identity with SEQ ID NO: 50 and/or a HFR4 comprising or consisting of a sequence having at least 50%, such as at least 60%, such as at least 70%, such as at least 80%, such as at least 90% identity with SEQ ID NO: 51. Suitably the polypeptide comprises a HFR1 comprising SEQ ID NO: 48, a HFR2 comprising SEQ ID NO: 49, a HFR3 comprising SEQ ID NO: 50 and/or a HFR4 comprising SEQ ID NO: 51. More suitably the polypeptide comprises a HFR1 consisting of SEQ ID NO: 48, a HFR2 consisting of SEQ ID NO: 49, a HFR3 consisting of SEQ ID NO: 50 and/or a HFR4 consisting of SEQ ID NO: 51.

The polypeptide may comprise four light chain framework regions (LFR1-LFR4).

The polypeptide may comprise a LFR1 comprising or consisting of a sequence having at least 50%, such as at least 60%, such as at least 70%, such as at least 80%, such as at least 90% identity with SEQ ID NO: 44, a LFR2 comprising or consisting of a sequence having at least 50%, such as at least 60%, such as at least 70%, such as at least 80%, such as at least 90% identity with SEQ ID NO: 45, a LFR3 comprising or consisting of a sequence having at least 50%, such as at least 60%, such as at least 70%, such as at least 80%, such as at least 90% identity with SEQ ID NO: 46 and/or a LFR4 comprising or consisting of a sequence having at least 50%, such as at least 60%, such as at least 70%, such as at least 80%, such as at least 90% identity with SEQ ID NO: 47. Suitably, the polypeptide comprises a LFR1 comprising SEQ ID NO: 44, a LFR2 comprising SEQ ID NO: 45, a LFR3 comprising SEQ ID NO: 46 and/or a LFR4 comprising SEQ ID NO: 47. More suitably, the polypeptide comprises a LFR1 consisting of SEQ ID NO: 44, a LFR2 consisting of SEQ ID NO: 45, a LFR3 consisting of SEQ ID NO: 46 and/or a LFR4 consisting of SEQ ID NO: 47.

Alternatively, the polypeptide may comprise a LFR1 comprising or consisting of a sequence having at least 50%, such as at least 60%, such as at least 70%, such as at least 80%, such as at least 90% identity with SEQ ID NO: 52, a LFR2 comprising or consisting of a sequence having at least 50%, such as at least 60%, such as at least 70%, such as at least 80%, such as at least 90% identity with SEQ ID NO: 53, a LFR3 comprising or consisting of a sequence having at least 50%, such as at least 60%, such as at least 70%, such as at least 80%, such as at least 90% identity with SEQ ID NO: 54 and/or a LFR4 comprising or consisting of a sequence having at least 50%, such as at least 60%, such as at least 70%, such as at least 80%, such as at least 90% identity with SEQ ID NO: 55. Suitably the polypeptide comprises a LFR1 comprising SEQ ID NO: 52, a LFR2 comprising SEQ ID NO: 53 a LFR3 comprising SEQ ID NO: 54 and/or a LFR4 comprising SEQ ID NO: 55. More suitably the polypeptide comprises a LFR1 consisting of SEQ ID NO: 52, a LFR2 consisting of SEQ ID NO: 53, a LFR3 consisting of SEQ ID NO: 54 and/or a LFR4 consisting of SEQ ID NO: 55.

The polypeptides of the invention may be described by reference to their VH and VL region sequences. The polypeptides may comprise a VH region and/or a VL region, most suitably a VH region and a VL region.

Specific polypeptides provided by the present invention and their VH and VL region sequences include the following:

TABLE 6

Specific combinations of VH and VL regions

| | VH | VL |
|---|---|---|
| Antibody 1 | 1 VH<br>SEQ ID NO: 23 | 1 VL<br>SEQ ID NO: 24 |
| Antibody 2 | 2 VH<br>SEQ ID NO: 25 | 2 VL<br>SEQ ID NO: 26 |
| Antibody 3 | 3 VH<br>SEQ ID NO: 27 | 3 VL<br>SEQ ID NO: 28 |
| Antibody 4 | 4 VH<br>SEQ ID NO: 29 | 4 VL<br>SEQ ID NO: 30 |
| Antibody 5 | 3 VH<br>SEQ ID NO: 27 | 5 VL<br>SEQ ID NO: 31 |
| Antibody 6 | 3 VH<br>SEQ ID NO: 27 | 6 VL<br>SEQ ID NO: 32 |
| Antibody 7 | 7 VH<br>SEQ ID NO: 33 | 7 VL<br>SEQ ID NO: 34 |
| Antibody 8 | 7 VH<br>SEQ ID NO: 33 | 11 VL<br>SEQ ID NO: 39 |
| Antibody 9 | 9 VH<br>SEQ ID NO: 35 | 11 VL<br>SEQ ID NO: 39 |
| Antibody 10 | 12 VH<br>SEQ ID NO: 36 | 11 VL<br>SEQ ID NO: 39 |
| Antibody 11 | 11 VH<br>SEQ ID NO: 37 | 11 VL<br>SEQ ID NO: 39 |
| Antibody 12 | 12 VH<br>SEQ ID NO: 36 | 12 VL<br>SEQ ID NO: 38 |
| Antibody 13 | 11 VH<br>SEQ ID NO: 37 | 12 VL<br>SEQ ID NO: 38 |
| Antibody 14 | 14 VH<br>SEQ ID NO: 96 | 14 VL<br>SEQ ID NO: 97 |
| Antibody 15 | 12 VH<br>SEQ ID NO: 36 | 15 VL<br>SEQ ID NO: 99 |
| Antibody 16 | 12 VH<br>SEQ ID NO: 36 | 15 VL<br>SEQ ID NO: 99 |
| Antibody 17 | 17 VH<br>SEQ ID NO: 102 | 15 VL<br>SEQ ID NO: 99 |
| Antibody 18 | 17 VH<br>SEQ ID NO: 102 | 18 VL<br>SEQ ID NO: 104 |
| 63D8 | 63D8 VH<br>SEQ ID NO: 113 | 63D8 VL<br>SEQ ID NO: 114 |

The VH region may comprise an amino acid sequence having at least 60%, such as at least 70%, such as at least 80%, such as at least 90%, such as at least 95%, such as at least 98%, such as at least 99% sequence identity with any one of SEQ ID NOs: 23, 25, 27, 29, 33, 35, 36, 37, 96 or 102. Suitably the VH region consists of an amino acid sequence having at least 60%, such as at least 70%, such as at least 80%, such as at least 90%, such as at least 95%, such as at least 98%, such as at least 99% sequence identity with any one of SEQ ID NOs: 23, 25, 27, 29, 33, 35, 36, 37, 96 or 102. Suitably the VH region comprises an amino acid sequence of SEQ ID NOs: 23, 25, 27, 29, 33, 35, 36, 37, 96 or 102, more suitably the VH region comprises an amino acid sequence of SEQ ID NO: 36 or SEQ ID NO: 37. Alternatively, the VH region comprises the amino acid sequence of SEQ ID NO: 102. Suitably the VH region consists of an amino acid sequence of SEQ ID NOs: 23, 25, 27, 29, 33, 35, 36, 37, 96 or 102, more suitably the VH region consists of an amino acid sequence of SEQ ID NO: 36 or SEQ ID NO: 37. Alternatively, the VH region consists of the amino acid sequence of SEQ ID NO: 102.

The VL region may comprise an amino acid sequence having at least 60%, such as at least 70%, such as at least 80%, such as at least 90%, such as at least 95%, such as at least 98%, such as at least 99% sequence identity with any one of SEQ ID NOs: 24, 26, 28, 30, 31, 32, 34, 38, 39, 97, 99 or 104. Suitably the VL region consists of an amino acid sequence having at least 60%, such as at least 70%, such as at least 80%, such as at least 90%, such as at least 95%, such as at least 98%, such as at least 99% sequence identity with any one of SEQ ID NOs: 24, 26, 28, 30, 31, 32, 34, 38, 39, 97, 99 or 104.

Suitably the VL region comprises an amino acid sequence of SEQ ID NOs: 24, 26, 28, 30, 31, 32, 34, 38, 39, 97, 99 or 104. More suitably the VL region comprises an amino acid sequence of SEQ ID NO: 38 or SEQ ID NO: 39. Alternatively, the VL region comprises an amino acid sequence of SEQ ID NO: 99 or SEQ ID NO: 104.

Suitably the VL region consists of an amino acid sequence of SEQ ID NOs: 24, 26, 28, 30, 31, 32, 34, 38, 39, 97, 99 or 104. More suitably the VL region consists of an amino acid sequence of SEQ ID NO: 38 or SEQ ID NO: 39. Alternatively, the VL region consists of an amino acid sequence of SEQ ID NO: 99 or SEQ ID NO: 104.

In one embodiment the polypeptide comprises
- (a) a VH region comprising SEQ ID NO: 23 and a VL region comprising SEQ ID NO: 24;
- (b) a VH region comprising SEQ ID NO: 25 and a VL region comprising SEQ ID NO: 26;
- (c) a VH region comprising SEQ ID NO: 27 and a VL region comprising SEQ ID NO: 28;
- (d) a VH region comprising SEQ ID NO: 29 and a VL region comprising SEQ ID NO: 30;
- (e) a VH region comprising SEQ ID NO: 27 and a VL region comprising SEQ ID NO: 31;
- (f) a VH region comprising SEQ ID NO: 27 and a VL region comprising SEQ ID NO: 32;
- (g) a VH region comprising SEQ ID NO: 33 and a VL region comprising SEQ ID NO: 34;
- (h) a VH region comprising SEQ ID NO: 33 and a VL region comprising SEQ ID NO: 39;
- (i) a VH region comprising SEQ ID NO: 35 and a VL region comprising SEQ ID NO: 39;
- (j) a VH region comprising SEQ ID NO: 36 and a VL region comprising SEQ ID NO: 39;
- (k) a VH region comprising SEQ ID NO: 37 and a VL region comprising SEQ ID NO: 39;
- (l) a VH region comprising SEQ ID NO: 36 and a VL region comprising SEQ ID NO: 38;
- (m) a VH region comprising SEQ ID NO: 37 and a VL region comprising SEQ ID NO: 38;
- (n) a VH region comprising SEQ ID NO: 96 and a VL region comprising SEQ ID NO: 97;
- (o) a VH region comprising SEQ ID NO: 36 and a VL region comprising SEQ ID NO: 99;
- (p) a VH region comprising SEQ ID NO: 102 and a VL region comprising SEQ ID NO: 99 or
- (q) a VH region comprising SEQ ID NO: 102 and a VL region comprising SEQ ID NO: 104.

More suitably, the polypeptide comprises
- (a) a VH region consisting of SEQ ID NO: 23 and a VL region consisting of SEQ ID NO: 24;
- (b) a VH region consisting of SEQ ID NO: 25 and a VL region consisting of SEQ ID NO: 26;
- (c) a VH region consisting of SEQ ID NO: 27 and a VL region consisting of SEQ ID NO: 28;
- (d) a VH region consisting of SEQ ID NO: 29 and a VL region consisting of SEQ ID NO: 30;
- (e) a VH region consisting of SEQ ID NO: 27 and a VL region consisting of SEQ ID NO: 31;
- (f) a VH region consisting of SEQ ID NO: 27 and a VL region consisting of SEQ ID NO: 32;
- (g) a VH region consisting of SEQ ID NO: 33 and a VL region consisting of SEQ ID NO: 34;
- (h) a VH region consisting of SEQ ID NO: 33 and a VL region consisting of SEQ ID NO: 39;

(i) a VH region consisting of SEQ ID NO: 35 and a VL region consisting of SEQ ID NO: 39;

(j) a VH region consisting of SEQ ID NO: 36 and a VL region consisting of SEQ ID NO: 39;

(k) a VH region consisting of SEQ ID NO: 37 and a VL region consisting of SEQ ID NO: 39;

(l) a VH region consisting of SEQ ID NO: 36 and a VL region consisting of SEQ ID NO: 38;

(m) a VH region consisting of SEQ ID NO: 37 and a VL region consisting of SEQ ID NO: 38;

(n) a VH region consisting of SEQ ID NO: 96 and a VL region consisting of SEQ ID NO: 97;

(o) a VH region consisting of SEQ ID NO: 36 and a VL region consisting of SEQ ID NO: 99;

(p) a VH region consisting of SEQ ID NO: 102 and a VL region consisting of SEQ ID NO: 99 or (q) a VH region consisting of SEQ ID NO: 102 and a VL region consisting of SEQ ID NO: 104.

The inventors have identified multiple residues in the polypeptides of the invention which may be substituted without significant loss of function, without loss of function, or which provide enhancement of function (see, for example, Example 7 and Table 10).

Accordingly, in one embodiment the polypeptide comprises three heavy chain CDRs (HCDR1-HCDR3) and three light chain CDRs (LCDR1-LCDR3) (wherein the CDRs in this embodiment are defined by a non-Kabat numbering system) wherein HCDR1 comprises (e.g. consists of) $X_1X_2X_3X_4X_5X_6$ (SEQ ID NO: 72), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 76), HCDR3 comprises (e.g. consists of) $DX_{20}X_{21}X_{22}X_{23}X_{24}X_{25}X_{26}X_{27}X_{28}X_{29}DY$ (SEQ ID NO: 80), LCDR1 comprises (e.g. consists of) $X_{30}X_{31}X_{32}X_{33}X_{34}X_{35}X_{36}X_{37}X_{38}X_{39}X_{40}$ (SEQ ID NO: 84), LCDR2 comprises (e.g. consists of) $X_{41}AX_{42}X_{43}X_{44}X_{45}X_{46}$ (SEQ ID NO: 88) and LCDR3 comprises (e.g. consists of) $X_{47}X_{48}X_{49}X_{50}X_{51}X_{52}PLX_{53}$ (SEQ ID NO: 92), wherein:

the amino acid of $X_1$ is selected from the group consisting of S, Y, T, G, R, E, K, D and N;

the amino acid of $X_2$ is selected from the group consisting of K, R, L, T, G, V, A, S, F, W, Q, M, Y, I, E, H, N, D and P;

the amino acid of $X_3$ is selected from the group consisting of R, K, H, T, S, F, G, V, A, L, N, Q, E, M, P, W and I;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V, A, K, M, H and Y;

the amino acid of $X_7$ is selected from the group consisting of E;

the amino acid of $X_8$ is selected from the group consisting of L, Q and D;

the amino acid of $X_9$ is selected from the group consisting of P, A, G, F, S, T and W;

the amino acid of $X_{10}$ is selected from the group consisting of R;

the amino acid of $X_{11}$ is selected from the group consisting of S, T and D;

the amino acid of $X_{12}$ is selected from the group consisting of G, R, S, Y, A, T, D, E and W;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M, P, W, H, L, I, S, T and A;

the amino acid of $X_{17}$ is selected from the group consisting of Q, A, I, S, P, T, N, V, G, H, L, M, W, K, R, F, D, Y and E;

the amino acid of $X_{18}$ is selected from the group consisting of G, D, E, H, L, V, Y, A, F, I, K, Q, W, R, M, P, S and N;

the amino acid of $X_{19}$ is selected from the group consisting of T, K, Q, E, R and M;

the amino acid of $X_{20}$ is selected from the group consisting of R, F, K, I, A, L, V, W, Y, M, P, Q, G and S;

the amino acid of $X_{21}$ is not present or is selected from the group consisting of K and R the amino acid of $X_{22}$ is selected from the group consisting of K, R, A, H, S, Q, T, P, M, W, Y, G, L, F, V, E and N;

the amino acid of $X_{23}$ is not present or is selected from the group consisting of K and R the amino acid of $X_{24}$ is selected from the group consisting of R, Y, A, H, P, L, K, G, Q, N, I, F, W, S, T, M, E, V and D;

the amino acid of $X_{25}$ is selected from the group consisting of A, Q, T, S, G, V, R, I, H, K, P, L, M and F;

the amino acid of $X_{26}$ is selected from the group consisting of R and S;

the amino acid of $X_{27}$ is selected from the group consisting of Y, H, Q and A;

the amino acid of $X_{28}$ is selected from the group consisting of A, T, S, D and E;

the amino acid of $X_{29}$ is selected from the group consisting of M and L;

the amino acid of $X_{30}$ is selected from the group consisting of Q, K, R, S and T;

the amino acid of $X_{31}$ is selected from the group consisting of A, S and T;

the amino acid of $X_{32}$ is selected from the group consisting of S, T and D;

the amino acid of $X_{33}$ is selected from the group consisting of Q, G, R, K, L, M, P, Y, S, A, N, H, W, D, E, F, T and I;

the amino acid of $X_{34}$ is selected from the group consisting of S, G, H, N, T, Y and D;

the amino acid of $X_{35}$ is selected from the group consisting of V, A and I;

the amino acid of $X_{36}$ is selected from the group consisting of R, K, S, G and A;

the amino acid of $X_{37}$ is selected from the group consisting of Y, F, L, Q, S, H, T, G, I, M, V, W, K, N, R, D and P;

the amino acid of $X_{38}$ is selected from the group consisting of N, A, G, H, Q, S, Y, F and W;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, T, A, D, K, L, N, Q, M, W, E, F and S;

the amino acid of $X_{42}$ is selected from the group consisting of S, K, M, Q, R, V, Y, G, E, D, T, A, F, I, N, W, H and L;

the amino acid of $X_{43}$ is selected from the group consisting of N, K, R, Q, T, Y, A, S, D and E;

the amino acid of $X_{44}$ is selected from the group consisting of R, L, K and A;

the amino acid of $X_{45}$ is selected from the group consisting of Y, I, K, M, Q, R, V, A, N, S, W, H, L, T, P, D, F, G and E;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q, S and L;

the amino acid of $X_{48}$ is selected from the group consisting of H, N, S, T, A, Q and V;

the amino acid of $X_{49}$ is selected from the group consisting of H, A, D and F;

the amino acid of $X_{50}$ is selected from the group consisting of Y and L;

the amino acid of $X_{51}$ is selected from the group consisting of S, K, V, D, N, R, H, T, A, G, Q, I, M, F, W, Y and L;

the amino acid of $X_{52}$ is selected from the group consisting of S, A, T, G, V, W and Y; and the amino acid of $X_{53}$ is selected from the group consisting of T and Y.

Accordingly, in a further embodiment the polypeptide comprises three heavy chain CDRs (HCDR1-HCDR3) and three light chain CDRs (LCDR1-LCDR3) (wherein the CDRs in this embodiment are defined by a non-Kabat numbering system) wherein HCDR1 comprises (e.g. consists of) $X_1X_2X_3X_4X_5X_6$ (SEQ ID NO: 73), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 77), HCDR3 comprises (e.g. consists of) $DX_{20}X_{21}X_{22}X_{23}X_{24}X_{25}X_{26}X_{27}X_{28}X_{29}DY$ (SEQ ID NO: 81), LCDR1 comprises (e.g. consists of) $X_{30}X_{31}X_{32}X_{33}X_{34}X_{35}X_{36}X_{37}X_{38}X_{39}X_{40}$ (SEQ ID NO: 85), LCDR2 comprises (e.g. consists of) $X_{41}AX_{42}X_{43}X_{44}X_{45}X_{46}$ (SEQ ID NO: 89) and LCDR3 comprises (e.g. consists of) $X_{47}X_{48}X_{49}X_{50}X_{51}X_{52}PLX_{53}$ (SEQ ID NO: 93), wherein:

the amino acid of $X_1$ is selected from the group consisting of S, Y, T, G, R, E and K;

the amino acid of $X_2$ is selected from the group consisting of K, R, L, T, G, V, A, S, F, W, Q, M, Y, I, E, H and N;

the amino acid of $X_3$ is selected from the group consisting of R, K, H, T, S, F, G, V, A, L, N, Q, E, M, P and W;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V, A, K and M;

the amino acid of $X_7$ is selected from the group consisting of E;

the amino acid of $X_8$ is selected from the group consisting of L and Q;

the amino acid of $X_9$ is selected from the group consisting of P, A, G, F, S and T;

the amino acid of $X_{10}$ is selected from the group consisting of R;

the amino acid of $X_{11}$ is selected from the group consisting of S, T and D;

the amino acid of $X_{12}$ is selected from the group consisting of G, R, S, Y, A, T, D, E and W;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M, P, W, H and L;

the amino acid of $X_{17}$ is selected from the group consisting of Q, A, I, S, P, T, N, V, G, H, L, M, W, K, R, F, D, Y and E;

the amino acid of $X_{18}$ is selected from the group consisting of G, D, E, H, L, V, Y, A, F, I, K, Q, W, R, M, P and S;

the amino acid of $X_{19}$ is selected from the group consisting of T, K, Q, E, R and M;

the amino acid of $X_{20}$ is selected from the group consisting of R, F, K, I, A, L, V, W, Y and M;

the amino acid of $X_{21}$ is not present or is selected from the group consisting of K and R the amino acid of $X_{22}$ is selected from the group consisting of K, R, A, H, S, Q, T, P, M, W, Y, G, L, F and V;

the amino acid of $X_{23}$ is not present or is selected from the group consisting of K and R the amino acid of $X_{24}$ is selected from the group consisting of R, Y, A, H, P, L, K, G, Q, N, I, F, W, S, T, M, E, V and D;

the amino acid of $X_{25}$ is selected from the group consisting of A, Q, T, S, G, V, R and I;

the amino acid of $X_{26}$ is selected from the group consisting of R and S;

the amino acid of $X_{27}$ is selected from the group consisting of Y;

the amino acid of $X_{28}$ is selected from the group consisting of A, T, S and D;

the amino acid of $X_{29}$ is selected from the group consisting of M and L;

the amino acid of $X_{30}$ is selected from the group consisting of Q, K, R, S and T;

the amino acid of $X_{31}$ is selected from the group consisting of A, S and T;

the amino acid of $X_{32}$ is selected from the group consisting of S, T and D;

the amino acid of $X_{33}$ is selected from the group consisting of Q, G, R, K, L, M, P, Y, S, A, N, H, W, D and E;

the amino acid of $X_{34}$ is selected from the group consisting of S, G, H, N, T and Y;

the amino acid of $X_{35}$ is selected from the group consisting of V, A and I;

the amino acid of $X_{36}$ is selected from the group consisting of R, K, S and G;

the amino acid of $X_{37}$ is selected from the group consisting of Y, F, L, Q, S, H, T, G, I, M, V, W, K, N and R;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, T, A, D, K, L, N and Q;

the amino acid of $X_{42}$ is selected from the group consisting of S, K, M, Q, R, V, Y, G, E, D, T, A, F, I, N, W and H;

the amino acid of $X_{43}$ is selected from the group consisting of N, K, R, Q, T, Y, A, S, D and E;

the amino acid of $X_{44}$ is selected from the group consisting of R, L and K;

the amino acid of $X_{45}$ is selected from the group consisting of Y, I, K, M, Q, R, V, A, N, S, W, H, L, T, P, D, F and G;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q, S and L;

the amino acid of $X_{48}$ is selected from the group consisting of H, N, S, T, A and Q;

the amino acid of $X_{49}$ is selected from the group consisting of H;

the amino acid of $X_{50}$ is selected from the group consisting of Y and L;

the amino acid of $X_{51}$ is selected from the group consisting of S, K, V, D, N, R, H, T, A, G, Q, I, M, F, W and Y;

the amino acid of $X_{52}$ is selected from the group consisting of S, A, T and G; and the amino acid of $X_{53}$ is selected from the group consisting of T and Y.

Accordingly, in a further embodiment the polypeptide comprises three heavy chain CDRs (HCDR1-HCDR3) and three light chain CDRs (LCDR1-LCDR3) (wherein the CDRs in this embodiment are defined by a non-Kabat numbering system) wherein HCDR1 comprises (e.g. consists of) $X_1X_2X_3X_4X_5X_6$ (SEQ ID NO: 74), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 78), HCDR3 comprises (e.g. consists of) $DX_{20}X_{21}X_{22}X_{23}X_{24}X_{25}X_{26}X_{27}X_{28}X_{29}DY$ (SEQ ID NO: 82), LCDR1 comprises (e.g. consists of) $X_{30}X_{31}X_{32}X_{33}X_{34}X_{35}X_{36}X_{37}X_{38}X_{39}X_{40}$ (SEQ ID NO: 86), LCDR2 comprises (e.g. consists of) $X_{41}AX_{42}X_{43}X_{44}X_{45}X_{46}$ (SEQ ID NO: 90) and LCDR3 comprises (e.g. consists of) $X_{47}X_{48}X_{49}X_{50}X_{51}X_{52}PLX_{53}$ (SEQ ID NO: 94), wherein:

the amino acid of $X_1$ is selected from the group consisting of S, Y, T, G and R;

the amino acid of $X_2$ is selected from the group consisting of K, R, L, T, G, V, A, S, F, W, Q, M, Y, I and E;

the amino acid of $X_3$ is selected from the group consisting of R, K, H, T, S, F, G, V, A, L, N and Q;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V and A;

the amino acid of $X_7$ is selected from the group consisting of E;

the amino acid of $X_8$ is selected from the group consisting of L and Q;

the amino acid of $X_9$ is selected from the group consisting of P, A, G, F and S;

the amino acid of $X_{10}$ is selected from the group consisting of R;

the amino acid of $X_{11}$ is selected from the group consisting of S and T;

the amino acid of $X_{12}$ is selected from the group consisting of G, R, S, Y, A and T;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M and P;

the amino acid of $X_{17}$ is selected from the group consisting of Q, A, I, S, P, T, N, V, G, H, L, M, W, K, R and F;

the amino acid of $X_{18}$ is selected from the group consisting of G, D, E, H, L, V, Y, A, F, I, K, Q, W, R, M, P and S;

the amino acid of $X_{19}$ is selected from the group consisting of T, K, Q, E, R and M;

the amino acid of $X_{20}$ is selected from the group consisting of R, F, K, I, A, L, V, W and Y;

the amino acid of $X_{21}$ is not present or is selected from the group consisting of K and R the amino acid of $X_{22}$ is selected from the group consisting of K, R, A, H, S, Q, T, P, M, W, G and Y;

the amino acid of $X_{23}$ is not present or is selected from the group consisting of K and R the amino acid of $X_{24}$ is selected from the group consisting of R, Y, A, H, P, L, K, G, Q, N, I, F, W, S, T, M, E and V;

the amino acid of $X_{25}$ is selected from the group consisting of A, Q, T, S, G and V; the amino acid of $X_{26}$ is selected from the group consisting of R;

the amino acid of $X_{27}$ is selected from the group consisting of Y;

the amino acid of $X_{28}$ is selected from the group consisting of A, T, S and D;

the amino acid of $X_{29}$ is selected from the group consisting of M;

the amino acid of $X_{30}$ is selected from the group consisting of Q, K, R, S and T;

the amino acid of $X_{31}$ is selected from the group consisting of A, S and T;

the amino acid of $X_{32}$ is selected from the group consisting of S, T and D;

the amino acid of $X_{33}$ is selected from the group consisting of Q, G, R, K, L, M, P, Y, S, A, N, H and W;

the amino acid of $X_{34}$ is selected from the group consisting of S, G, H, N, T and Y;

the amino acid of $X_{35}$ is selected from the group consisting of V, A and I;

the amino acid of $X_{36}$ is selected from the group consisting of R, K and S;

the amino acid of $X_{37}$ is selected from the group consisting of Y, F, L, Q, S, H, T, G, I, M, V, W, K, N and R;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, and T;

the amino acid of $X_{42}$ is selected from the group consisting of S, K, M, Q, R, V, Y, G, E, D, T, A, F, I, N and W;

the amino acid of $X_{43}$ is selected from the group consisting of N, K, R, Q, T, Y, A and S;

the amino acid of $X_{44}$ is selected from the group consisting of R, L and K;

the amino acid of $X_{45}$ is selected from the group consisting of Y, I, K, M, Q, R, V, A, N, S, W, H, L, T, P, D and F;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q and S;

the amino acid of $X_{48}$ is selected from the group consisting of H, N, S, T, A and Q;

the amino acid of $X_{49}$ is selected from the group consisting of H;

the amino acid of $X_{50}$ is selected from the group consisting of Y;

the amino acid of $X_{51}$ is selected from the group consisting of S, K, V, D, N, R, H, T, A and G;

the amino acid of $X_{52}$ is selected from the group consisting of S and A; and the amino acid of $X_{53}$ is selected from the group consisting of T and Y.

Accordingly, in a further embodiment the polypeptide comprises three heavy chain CDRs (HCDR1-HCDR3) and three light chain CDRs (LCDR1-LCDR3) (wherein the CDRs in this embodiment are defined by a non-Kabat numbering system) wherein HCDR1 comprises (e.g. consists of) $X_1X_2X_3X_4X_5X_6$ (SEQ ID NO: 75), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 79), HCDR3 comprises (e.g. consists of) $DX_{20}X_{21}X_{22}X_{23}X_{24}X_{25}X_{26}X_{27}X_{28}X_{29}DY$ (SEQ ID NO: 83), LCDR1 comprises (e.g. consists of) $X_{30}X_{31}X_{32}X_{33}X_{34}X_{35}X_{36}X_{37}X_{38}X_{39}X_{40}$ (SEQ ID NO: 87), LCDR2 comprises (e.g. consists of) $X_{41}AX_{42}X_{43}X_{44}X_{45}X_{46}$ (SEQ ID NO: 91) and LCDR3 comprises (e.g. consists of) $X_{47}X_{48}X_{49}X_{50}X_{51}X_{52}PLX_{53}$ (SEQ ID NO: 95), wherein:

the amino acid of $X_1$ is selected from the group consisting of S, Y, T and G;

the amino acid of $X_2$ is selected from the group consisting of K, R, L, T, G, V, A, S, F, W, Q, M and Y;

the amino acid of $X_3$ is selected from the group consisting of R, K, H, T, S, F, G and V;

the amino acid of $X_4$ is selected from the group consisting of A and G;

the amino acid of $X_5$ is selected from the group consisting of M and I;

the amino acid of $X_6$ is selected from the group consisting of S, E, G, D, L and T;

the amino acid of $X_7$ is selected from the group consisting of E;

the amino acid of $X_8$ is selected from the group consisting of L and Q;

the amino acid of $X_9$ is selected from the group consisting of P, A and G;

the amino acid of $X_{10}$ is selected from the group consisting of R;

the amino acid of $X_{11}$ is selected from the group consisting of S and T;

the amino acid of $X_{12}$ is selected from the group consisting of G and R;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D and E;

the amino acid of $X_{17}$ is selected from the group consisting of Q, A, I, S, P, T, N and V;

the amino acid of $X_{18}$ is selected from the group consisting of G, D, E, H, L, V, Y, A, F, I, K, Q, W and R;

the amino acid of $X_{19}$ is selected from the group consisting of T and K;

the amino acid of $X_{20}$ is selected from the group consisting of R, F, K and I;

the amino acid of $X_{21}$ is not present or is selected from the group consisting of K and R the amino acid of $X_{22}$ is selected from the group consisting of K, G and R;

the amino acid of $X_{23}$ is not present or is selected from the group consisting of K and R the amino acid of $X_{24}$ is selected from the group consisting of R, Y, A, H, P, L, K, G, Q, N, I, F and W;

the amino acid of $X_{25}$ is selected from the group consisting of A, Q, T, S and G;

the amino acid of $X_{26}$ is selected from the group consisting of R;

the amino acid of $X_{27}$ is selected from the group consisting of Y;

the amino acid of $X_{28}$ is selected from the group consisting of A, T and S;

the amino acid of $X_{29}$ is selected from the group consisting of M;

the amino acid of $X_{30}$ is selected from the group consisting of Q, K, R, S and T;

the amino acid of $X_{31}$ is selected from the group consisting of A and S;

the amino acid of $X_{32}$ is selected from the group consisting of S and T;

the amino acid of $X_{33}$ is selected from the group consisting of Q, G, R, K, L, M, P, Y and S;

the amino acid of $X_{34}$ is selected from the group consisting of S, G, H and N;

the amino acid of $X_{35}$ is selected from the group consisting of V, A and I;

the amino acid of $X_{36}$ is selected from the group consisting of R;

the amino acid of $X_{37}$ is selected from the group consisting of Y, F, L, Q, S, H, T, G, I, M, V and W;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A and G;

the amino acid of $X_{41}$ is selected from the group consisting of Y and H the amino acid of $X_{42}$ is selected from the group consisting of S, K, M, Q, R, V, Y, G and E, the amino acid of $X_{43}$ is selected from the group consisting of N, K and R;

the amino acid of $X_{44}$ is selected from the group consisting of R, L and K;

the amino acid of $X_{45}$ is selected from the group consisting of Y, I, K, M, Q, R, V, A, N, S, W and H;

the amino acid of $X_{46}$ is selected from the group consisting of T, A, D, E, Q, R, S, H, K, P, L, F, G, I, M and V;

the amino acid of $X_{47}$ is selected from the group consisting of Q;

the amino acid of $X_{48}$ is selected from the group consisting of H, N, S and T;

the amino acid of $X_{49}$ is selected from the group consisting of H;

the amino acid of $X_{50}$ is selected from the group consisting of Y;

the amino acid of $X_{51}$ is selected from the group consisting of S, K and V;

the amino acid of $X_{52}$ is selected from the group consisting of S and A; and the amino acid of $X_{53}$ is selected from the group consisting of T.

In one embodiment the polypeptide comprises three heavy chain CDRs (HCDR1-HCDR3) and three light chain CDRs (LCDR1-LCDR3) (wherein the CDRs in this embodiment are defined by a non-Kabat numbering system) wherein HCDR1 comprises (e.g. consists of) $X_1X_2X_3X_4X_5X_6$ (SEQ ID NO: 72), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 76), HCDR3 comprises (e.g. consists of) $DX_{20}X_{21}X_{22}X_{23}X_{24}X_{25}X_{26}X_{27}X_{28}X_{29}DY$ (SEQ ID NO: 80), LCDR1 comprises (e.g. consists of) $X_{30}X_{31}X_{32}X_{33}X_{34}X_{35}X_{36}X_{37}X_{38}X_{39}X_{40}$ (SEQ ID NO: 84), LCDR2 comprises (e.g. consists of) $X_{41}AX_{42}X_{43}X_{44}X_{45}X_{46}$ (SEQ ID NO: 88) and LCDR3 comprises $X_{47}X_{48}X_{49}X_{50}X_{51}X_{52}PLX_{53}$ (SEQ ID NO: 92), wherein the amino acids $X_1$ to $X_{53}$ correspond to $X_1$ to $X_{53}$ as recited in the 'CDR numbering' column of Table 10 and are each selected from the amino acids recited in the corresponding rows in the 'Residues tested' column of Table 10. More suitably, amino acids $X_1$ to $X_{53}$ are each selected from the amino acids recited in the corresponding rows in the '20-40% function of best residue', '40-60% function of best residue', '60-80% function of best residue' and 'Best Residue(s)' columns of Table 10. More suitably, amino acids $X_1$ to $X_{53}$ are each selected from the amino acids recited in the corresponding rows in the '40-60% function of best residue', '60-80% function of best residue' and 'Best Residue(s)' columns of Table 10. More suitably, amino acids $X_1$ to $X_{53}$ are each selected from the amino acids recited in the corresponding rows in the '60-80% function of best residue' and 'Best Residue(s)' columns of Table 10. Most suitably, amino acids $X_1$ to $X_{53}$ are each selected from the amino acids recited in the corresponding rows in the 'Best Residue(s)' column of Table 10.

In one embodiment the polypeptide comprises a VH region and a VL region wherein the VH region comprises (e.g. consists of) the polypeptide sequence

```
                                    (SEQ ID NO: 70)
QVQLVQSGSELKKPGASVKVSCKASGyTFX₁X₂X₃X₄

X₅X₆WVRQAPGQGLEWX₇GX₈IX₉X₁₀X₁₁X₁₂X₁₃X₁₄X₁₅

X₁₆YX₁₇X₁₈X₁₉FX₂₀GRFX₂₁X₂₂SADKSX₂₃STAYLQIS

SLKAEDTAVYX₂₄CARDX₂₅X₂₆X₂₇X₂₈X₂₉X₃₀X₃₁

X₃₂DYWX₃₃QGTTVTVSS
``` and the VL region comprises (e.g. consists of) the polypeptide sequence

```
                                    (SEQ ID NO: 71)
X₃₄IQMTQSPSSLSASVGDRVTITCX₃₅X₃₆X₃₇X₃₈X₃₉X₄₀X₄₁

X₄₂X₄₃X₄₄X₄₅WYQQKPGKAPKLLIYX₄₆AX₄₇X₄₈X₄₉X₅₀X₅₁G

VPSRFSGSGSGTDFTFTISSLQPEDIATYX₅₂CX₅₃X₅₄X₅₅

X₅₆X₅₇X₅₈PLX₅₉FGGGTKLEIK
``` wherein the amino acids $X_1$ to $X_{59}$ correspond to $X_1$ to $X_{59}$ as recited in the 'Full length numbering' column of Table 10 and are each selected from the amino acids recited in the corresponding rows in the 'Residues tested' column of Table 10 (wherein in this embodiment the CDRs are defined by a non-Kabat numbering system). More suitably, amino acids $X_1$ to $X_{59}$ are each selected from the amino acids recited in the corresponding rows in the '20-40% function of best residue', '40-60% function of best residue', '60-80% function of best residue' and 'Best Residue(s)' columns of Table 10. More suitably, amino acids $X_1$ to $X_{59}$ are each selected from the amino acids recited in the corresponding rows in the '40-60% function of best residue', '60-80% function of best residue' and 'Best Residue(s)' columns of Table 10. More suitably, amino acids $X_1$ to $X_{59}$ are each selected from the amino acids recited in the corresponding rows in the '60-80% function of best residue' and 'Best Residue(s)' columns of Table 10. Most suitably, amino acids $X_1$ to $X_{59}$ are each selected from the amino acids recited in the corresponding rows in the 'Best Residue(s)' column of Table 10.

In certain embodiments the residue of HCDR2 corresponding to residue number 5 of SEQ ID NO: 2 is arginine and/or the residue of HCDR3 corresponding to residue number 6 of SEQ ID NO: 3 is arginine and/or the residue of HCDR3 corresponding to residue number 7 of SEQ ID NO: 3 is tyrosine and/or the residue of LCDR2 corresponding to residue number 1 of SEQ ID NO: 5 is tyrosine and/or the residue of LCDR3 corresponding to residue number 3 of SEQ ID NO: 6 is histidine.

In certain embodiments residue H53 is arginine and/or residue H100 is arginine and/or residue H100A is tyrosine and/or residue L50 is tyrosine and/or residue L91 is histidine, according to Kabat numbering.

In certain embodiments, the residue corresponding to position 74 of SEQ ID NO: 70 may be selected from lysine or threonine.

In certain embodiments the polypeptide comprises the paratope residues selected as very highly probable in FIG. 4. Suitably, the residue corresponding to position 47 of SEQ ID NO: 418 is tryptophan, the residue corresponding to position 103 of SEQ ID NO: 418 is glycine, the residue corresponding to position 105 of SEQ ID NO: 418 is tyrosine, the residue corresponding to position 31 of SEQ ID NO: 39 is tyrosine, and the residue corresponding to position 92 of SEQ ID NO: 39 is tyrosine.

In further embodiments the polypeptide further comprises the paratope residues selected as highly probable in FIG. 4. Suitably, the residue corresponding to position 52 of SEQ ID NO: 418 is leucine, the residue corresponding to position 54 of SEQ ID NO: 418 is arginine, the residue corresponding to position 104 of SEQ ID NO: 418 is arginine, the residue corresponding to position 26 of SEQ ID NO: 39 is serine, the residue corresponding to position 27 of SEQ ID NO: 39 is glutamine, the residue corresponding to position 49 of SEQ ID NO: 39 is tyrosine, and the residue corresponding to position 91 of SEQ ID NO: 39 is histidine.

In further embodiments the polypeptide further comprises the paratope residues selected as probable in FIG. 4. Suitably, the residue corresponding to position 55 of SEQ ID NO: 418 is serine, the residue corresponding to position 58 of SEQ ID NO: 418 is threonine, the residue corresponding to position 59 of SEQ ID NO: 418 is asparagine, the residue corresponding to position 62 of SEQ ID NO: 418 is glutamine, the residue corresponding to position 100 of SEQ ID NO: 418 is phenylalanine, the residue corresponding to position 1 of SEQ ID NO: 39 is serine, the residue corresponding to position 29 of SEQ ID NO: 39 is valine, the residue corresponding to position 90 of SEQ ID NO: 39 is histidine, and the residue corresponding to position 93 of SEQ ID NO: 39 is serine.

In further embodiments the polypeptide further comprises the paratope residues selected as possible in FIG. 4. Suitably, the residue corresponding to position 31 of SEQ ID NO: 418 is serine, the residue corresponding to position 60 of SEQ ID NO: 418 is tyrosine, the residue corresponding to position 61 of SEQ ID NO: 418 is asparagine, the residue corresponding to position 65 of SEQ ID NO: 418 is threonine, the residue corresponding to position 99 of SEQ ID NO: 418 is aspartic acid, the residue corresponding to position 101 of SEQ ID NO: 418 is arginine, the residue corresponding to position 102 of SEQ ID NO: 418 is serine, the residue corresponding to position 25 of SEQ ID NO: 39 is alanine, the residue corresponding to position 30 of SEQ ID NO: 39 is arginine, the residue corresponding to position 67 of SEQ ID NO: 39 is serine, the residue corresponding to position 89 of SEQ ID NO: 39 is glutamine, and the residue corresponding to position 94 of SEQ ID NO: 39 is serine.

In one embodiment the VH region comprises, such as consists of, an amino acid sequence having at least 60%, such as at least 70%, such as at least 80%, such as at least 90%, such as at least 95%, such as at least 98%, such as at least 99%, such as 100% sequence identity with SEQ ID NO: 113. Suitably the VL region comprises, such as consists of, an amino acid sequence having at least 60%, such as at least 70%, such as at least 80%, such as at least 90%, such as at least 95%, such as at least 98%, such as at least 99%, such as 100% sequence identity with SEQ ID NO: 114.

The polypeptides of the invention may be described by reference to their heavy chain constant region sequences or light chain constant region sequences. The polypeptides of the invention may alternatively be described by reference to their heavy or light chain sequences. The polypeptides may comprise a heavy chain constant region and/or a light chain constant region, most suitably a heavy chain constant region and a light chain constant region.

Specific constant regions provided by the present invention include the following:

TABLE 7

Specific combinations of heavy chain, light chain and constant regions

| | Heavy constant | Light constant | Heavy chain | Light chain |
|---|---|---|---|---|
| Antibody 11 | 12 heavy constant SEQ ID NO: 56 | 12 light constant SEQ ID NO: 57 | 11 HC SEQ ID NO: 60 | 11 LC SEQ ID NO: 61 |
| Antibody 12 | 12 heavy constant SEQ ID NO: 56 | 12 light constant SEQ ID NO: 57 | 12 HC SEQ ID NO: 58 11 HC | 12 LC SEQ ID NO: 59 |
| Antibody 13 | 12 heavy constant SEQ ID NO: 56 | 12 light constant SEQ ID NO: 57 | 12 HC SEQ ID NO: 60 | 12 LC SEQ ID NO: 59 |
| Antibody 15 | 12 heavy constant SEQ ID NO: 56 | 12 light constant SEQ ID NO: 57 | 12 HC SEQ ID NO: 58 | 15 LC SEQ ID NO: 1219 |
| Antibody 16 | 16 heavy constant SEQ ID NO: 1235 | 12 light constant SEQ ID NO: 57 | 16 HC SEQ ID NO: 1236 | 15 LC SEQ ID NO: 1219 |
| Antibody 17 | 12 heavy constant SEQ ID NO: 56 | 12 light constant SEQ ID NO: 57 | 17 HC SEQ ID NO: 1220 | 15 LC SEQ ID NO: 1219 |

TABLE 7-continued

Specific combinations of heavy chain, light chain and constant regions

| | Heavy constant | Light constant | Heavy chain | Light chain |
|---|---|---|---|---|
| Antibody 18 | 12 heavy constant SEQ ID NO: 56 | 12 light constant SEQ ID NO: 57 | 17 HC SEQ ID NO: 1220 | 18 LC SEQ ID NO: 1221 |

Suitably the heavy chain comprises a polypeptide sequence having at least 50%, such as at least 70%, such as at least 90% identity with SEQ ID NO: 58, SEQ ID NO: 60, SEQ ID NO: 1220 or SEQ ID NO: 1236. More suitably the heavy chain comprises SEQ ID NO: 58, SEQ ID NO: 60, SEQ ID NO: 1220 or SEQ ID NO: 1236. More suitably the heavy chain consists of SEQ ID NO: 58, SEQ ID NO: 60, SEQ ID NO: 1220 or SEQ ID NO: 1236.

Suitably the heavy chain comprises a polypeptide sequence having at least 50%, such as at least 70%, such as at least 90% identity with SEQ ID NO: 58 or SEQ ID NO: 60. More suitably the heavy chain comprises SEQ ID NO: 58 or SEQ ID NO: 60. More suitably the heavy chain consists of SEQ ID NO: 58 or SEQ ID NO: 60.

Suitably the light chain comprises a polypeptide sequence having at least 50%, such as at least 70%, such as at least 90% identity with SEQ ID NO: 59, SEQ ID NO: 61, SEQ ID NO: 1219 or SEQ ID NO: 1221. More suitably the light chain comprises SEQ ID NO: 59, SEQ ID NO: 61, SEQ ID NO: 1219 or SEQ ID NO: 1221. More suitably the light chain consists of SEQ ID NO: 59, SEQ ID NO: 61, SEQ ID NO: 1219 or SEQ ID NO: 1221.

Suitably the light chain comprises a polypeptide sequence having at least 50%, such as at least 70%, such as at least 90% identity with SEQ ID NO: 59 or SEQ ID NO: 61. More suitably the light chain comprises SEQ ID NO: 59 or SEQ ID NO: 61. More suitably the light chain consists of SEQ ID NO: 59 or SEQ ID NO: 61.

The polypeptides of the invention may be described by reference to multiple combined polypeptide sequences.

Suitably the polypeptide (such as an antibody or fragment thereof) comprises a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 3, LCDR1 comprises or consists of a sequence having at least 80% identity with SEQ ID NO: 4, LCDR2 comprises or consists of a sequence having at least 80% identity with SEQ ID NO: 5 and LCDR3 comprises or consists of a sequence having at least 80% identity with SEQ ID NO: 6.

Suitably the polypeptide (such as an antibody or fragment thereof) comprises a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 15, LCDR1 comprises or consists of a sequence having at least 80% identity with SEQ ID NO: 4, LCDR2 comprises or consists of a sequence having at least 80% identity with SEQ ID NO: 5 and LCDR3 comprises or consists of a sequence having at least 80% identity with SEQ ID NO: 6.

Suitably the polypeptide (such as an antibody or fragment thereof) comprises a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 2, HCDR3 comprises or consists of a sequence having at least 80% identity with SEQ ID NO: 3, LCDR1 comprises or consists of a sequence having at least 80% identity with SEQ ID NO: 4, LCDR2 comprises or consists of a sequence having at least 80% identity with SEQ ID NO: 98 and LCDR3 comprises or consists of a sequence having at least 80% identity with SEQ ID NO: 6.

Suitably the polypeptide (such as an antibody or fragment thereof) comprises a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 100, HCDR3 comprises or consists of a sequence having at least 80% identity with SEQ ID NO: 101, LCDR1 comprises or consists of a sequence having at least 80% identity with SEQ ID NO: 4, LCDR2 comprises or consists of a sequence having at least 80% identity with SEQ ID NO: 98 and LCDR3 comprises or consists of a sequence having at least 80% identity with SEQ ID NO: 6.

Suitably the polypeptide (such as an antibody or fragment thereof) comprises a HCDR1, HCDR2, HCDR3, LCDR1, LCDR2 and LCDR3 wherein HCDR1 comprises or consists of a sequence having at least 80% identity with SEQ ID NO: 1, HCDR2 comprises or consists of a sequence having at least 80% identity with SEQ ID NO: 100, HCDR3 comprises or consists of a sequence having at least 80% identity with SEQ ID NO: 101, LCDR1 comprises or consists of a sequence having at least 80% identity with SEQ ID NO: 103, LCDR2 comprises or consists of a sequence having at least 80% identity with SEQ ID NO: 98 and LCDR3 comprises or consists of a sequence having at least 80% identity with SEQ ID NO: 6.

Suitably the polypeptide (such as an antibody or fragment thereof) comprises a VH region comprising or consisting of a sequence having at least 80% identity with SEQ ID NO: 36 or SEQ ID NO: 102 and a VL region comprising or consisting of a sequence having at least 80% identity with SEQ ID NO: 99 or 104.

Suitably the polypeptide (such as an antibody or fragment thereof) further comprises heavy and light chain constant regions.

Suitably the polypeptide (such as an antibody) comprises or consists of a heavy chain comprising or consisting of SEQ ID NO: 58 or SEQ ID NO: 61 and a light chain comprising or consisting of SEQ ID NO: 59 or SEQ ID NO: 60.

In one embodiment, there is provided a polypeptide of any one of the sequences disclosed herein. In one embodiment, there is provided a polynucleotide encoding any one of the polypeptide sequences disclosed herein.

Embodiments which refer herein to "at least 80%" or "80% or greater", will be understood to include all values equal to or greater than 80%, such as 85%, 90%, 95%, 97%, 98%, 99% or 100% sequence identity.

Instead of percentage sequence identity, equivalent embodiments may also be defined with one or more amino acid changes, for examples one or more additions, substitutions and/or deletions. In one embodiment, the sequence may comprise up to five amino acid changes, such as up to three amino acid changes, in particular up to two amino acid changes. For example, the sequence may comprise up to five amino acid substitutions, such as up to three amino acid substitutions, in particular up to one or two amino acid substitutions. For example, CDR3 of the polypeptide of the present invention may comprise or more suitably consist of a sequence having no more than 2, more suitably no more than 1 substitution(s) compared to any one of SEQ ID NOs: 3.

For fragments comprising both the VH and VL regions, these may be associated either covalently (e.g. via disulphide bonds or a linker) or non-covalently. The antibody fragment described herein may comprise an scFv, i.e. a fragment comprising a VH region and a VL region joined by a linker. In one embodiment, the VH and VL region are joined by a (e.g. synthetic) polypeptide linker. The polypeptide linker may comprise a $(Gly_4Ser)_n$ linker, where n=from 1 to 8, e.g. 2, 3, 4, 5, 6 or 7. In a further embodiment, the linker comprises SEQ ID NO: 69. In a further embodiment, the linker consists of SEQ ID NO: 69.

In one embodiment, there is provided a polypeptide comprising one or more of a HCDR1, HCDR2, HCDR3, LCDR1, LCDR2, LCDR3, VH or VL sequence provided in the accompanying sequence listing, or a polypeptide sharing at least 90%, such as at least 95%, such as at least 99% identity thereto. Most suitably, the polypeptide is an antibody or a fragment thereof.

Antibody Sequence Modifications

The antibodies and fragments thereof may be modified using known methods. Sequence modifications to antibody molecules described herein can be readily incorporate by those skilled in the art. The following examples are non-limiting.

During antibody discovery and sequence recovery from phage libraries, desired antibody variable domains may be re-formatted into full length IgG by sub-cloning. To accelerate the process, variable domains are often transferred using restriction enzymes. These restriction sites may introduce additional/alternate amino acids and away from the canonical sequence (such canonical sequences may be found, for example, in the international ImMunoGeneTics [IMGT] information system, see http://www.imgt.org). These may be introduced as kappa or lambda light chain sequence modifications.

Binding

The polypeptide of the invention may bind to the LPAR1 with a binding affinity ($K_D$) of less than $3.0 \times 10^{-7}$ M (i.e. 300 nM), less than $2.5 \times 10^{-7}$ M (i.e. 250 nM), less than $2.0 \times 10^{-7}$ M (i.e. 200 nM) or less than $1.5 \times 10^{-7}$ M (i.e. 150 nM). In a further embodiment, the $K_D$ is $1.3 \times 10^{-7}$ M (i.e. 130 nM) or less, such as $1.0 \times 10^{-7}$ M (i.e. 100 nM) or less. In a yet further embodiment, the $K_D$ is less than $6.0 \times 10^{-8}$ M (i.e. 60 nM), such as less than $5.0 \times 10^{-8}$ M (i.e. 50 nM), less than $4.0 \times 10^{-8}$ M (i.e. 40 nM), less than $3.0 \times 10^{-8}$ M (i.e. 30 nM) or less than $2.0 \times 10^{-8}$ M (i.e. 20 nM). In further embodiments, the $K_D$ may be $1.5 \times 10^{-8}$ M (i.e. 15 nM) or less, such as $1.0 \times 10^{-8}$ M (i.e. 10 nM) or less, $9.0 \times 10^{-9}$ M (i.e. 9 nM) or less, $8.0 \times 10^{-9}$ M (i.e. 8 nM) or less, $7.0 \times 10^{-9}$ M (i.e. 7 nM) or less, $6.0 \times 10^{-9}$ M (i.e. 6 nM) or less, $5.0 \times 10^{-9}$ M (i.e. 5 nM) or less, $4.0 \times 10^{-9}$ M (i.e. 4 nM) or less, $3.0 \times 10^{-9}$ M (i.e. 3 nM) or less, $2.0 \times 10^{-9}$ M (i.e. 2 nM) or less, or $1.5 \times 10^{-9}$ M (i.e. 1.5 nM) or less or $1.0 \times 10^{-9}$ M (i.e. 1 nM) or less. For example, according to one aspect, there is provided an anti-LPAR1 antibody which binds to the LPAR1 with a binding affinity ($K_D$) of less than $1.5 \times 10^{-7}$ M (i.e. 150 nM).

Suitably, the $K_D$ of a polypeptide of the invention is determined using a kinetic exclusion assay (KinExA; a type of bioassay in which a solution containing receptor, ligand, and receptor-ligand complex is exposed to additional ligand immobilized on a solid phase). Suitably, the KinExA uses LPAR1 expressing cells as the titrated binding partner. Suitably the $K_D$ is measured from a monovalent antibody, such as a Fab. In one embodiment, the $K_D$ of a polypeptide of the invention may be established by method 1.14 detailed under the Examples section below.

Functional Characterisation

Described herein are assays which may be used to characterise the function of the polypeptides of the invention. For example, the polypeptide described herein may be assessed by measuring calcium mobilisation or cAMP production. LPAR1 predominantly signals via Gi/o to inhibit cAMP production and Gq/11 to promote calcium mobilisation. LPAR1 also signals though G13 to promote Rho signalling.

The polypeptide described herein may also be assessed by measuring cell proliferation and migration. For example, DNA synthesis, a marker for cell proliferation, can be measured following application of the polypeptide to cells, e.g. by BrdU incorporation. Cell migration could be assessed by applying the polypeptide to cells before using a fluorescence microscope to count the proportion of cells which have migrated.

In functional assays, output may be measured by calculating the half maximal concentration, also referred to as "EC50" or "effective concentration at 50 percent". The term "IC50" refers to the inhibitory concentration. Both EC50 and IC50 may be measured using methods known in the art, such as flow cytometry methods. For the avoidance of doubt, the values of EC50 in the present application are provided using IgG1 formatted antibody. Such values can be easily converted based on the molecular weight of the antibody format for equivalent values as follows:

$$(\mu g/ml)/(MW\ in\ kDa) = \mu M$$

Millilitres may be denoted as "ml" or "mL" herein and used interchangeably.

The EC50 for downregulation upon polypeptide binding may be less than 0.5 µg/ml, such as less than 0.4 µg/ml, 0.3 µg/ml, 0.2 µg/ml, 0.15 µg/ml, 0.1 µg/ml or 0.05 µg/ml. In particular, said EC50 values are when the antibody is measured in an IgG1 format. For example, the EC50 value can be measured using flow cytometry.

In one embodiment the polypeptide of the invention modulates the function of LPAR1. More suitably the polypeptide on binding to LPAR1 is an inhibitor of LPAR1, such as an inverse agonist of LPAR1. In one embodiment the polypeptide of the invention is an allosteric inhibitor of LPAR1.

Suitably, binding to LPAR1 reduces Gi/o signalling by the LPAR1.

Suitably, binding to LPAR1 reduces or prevents LPA-induced or constitutive reduction in cAMP production (for example increases cAMP production in the assay detailed below (and utilised in Example 1.7)). In one embodiment, cAMP production is increased by at least 10%, such as at least 50%, such as at least 70%, such as at least 100%, such as at least 150%, such as at least 200%, such as at least 250%, such as at least 300%.

Suitably, binding to LPAR1 reduces or prevents LPA-induced calcium mobilisation (for example reduces calcium mobilisation in the assay detailed in Example 1.8).

In one embodiment the polypeptide on binding to LPAR1 reduces the activity of LPAR1 by at least 10%, such as at least 20%, such as at least 30%, such as at least 40%, such as at least 50%, such as at least 60%, such as at least 70%, such as at least 80%, such as at least 90%, such as at least 95%, such as at least 98%, such as at least 99%, such as at least 100%. More suitably the activity of LPAR1 is indicated by an assay detailed in Examples 1.1 to 1.16, such as the assay detailed in Example 1.7 or 1.11. Most suitably the activity of LPAR1 is indicated by the HTRF cAMP assay outlined below.

HTRF cAMP Assay

CHO-K1 EDG2 Gi/Gq cells are seeded in multi well plates at 3000 cells per 25 µL full growth medium and incubated for 24 hours at 37° C. Cells are serum starved for 4 hours at 37° C. Following serum starvation, medium is discarded and replaced with 5 µL cell assay buffer (HBSS+ 0.1% (w/v) BSA+20 mM HEPES). Cells are stimulated with human antibodies or human antibody-containing supernatants at various concentrations and incubated for 15 minutes at 37° C. After pre-incubation, cells are stimulated with LPA (0.5 µM) and forskolin (5 µM) and incubated for 1 hour at 37° C. cAMP-cryptate and anti-cAMP-d2 working solutions are prepared in lysis and detection buffer and added to all wells of the plate. After incubation in the dark for 1 hour at room temperature, the plates are read on a plate reader. cAMP concentrations are determined by applying 620/665 nm fluorescence ratios to a standard curve of known cAMP concentrations.

Binding of an antibody of the invention to LPAR1 on the surface of a live cell is suitably indicated using the transient transfection CIFAT assay outlined below.

Transient-Transfection CIFAT

CHO-K1 cells are seeded in multi well plates at 20,000 cells per 200 µL full growth medium and incubated for 24 hours at 37° C. In a sterile tube, 0.0309 uL/well PEI is diluted into 10 uL/well transfection medium (DMEM supplemented with 2 mM L-glutamine and Penicillin-Strep-tomycin). The diluted PEI is added to 100 ng/well DNA, before mixing immediately and incubating the mixture for 10 minutes at room temperature. 200 µL/well full growth medium is added to the PEI-DNA mixture, then medium in wells is taken off and 200 ul full growth medium/PEI/DNA mixture is added in the wells of the adherent cell plate. The plate is incubated for 24 hours at 37° C. The medium is discarded and replaced with 200 µL full growth medium. The plate is incubated for 24 hours at 37° C. Medium is removed from the wells and the cells incubated with primary antibody at varying concentrations for 75 minutes at 37° C. After washing and cell fixation with 4% PFA, the binding of the antibodies is detected using a goat anti-human detection antibody, incubated for 1 hour at room temperature. Fluorescence at 488 nm is measured.

Multi-Specific Antibodies

The antibodies of the present invention may be mono-specific or they may bind additional targets and are therefore bi-specific or multi-specific. Multi-specific antibodies may be specific for different epitopes of one target polypeptide or may be specific for more than one target polypeptide. Therefore, in one embodiment, the polypeptide of the invention is comprised in a construct which comprises a first binding specificity to LPAR1 and a second binding specificity for a second target epitope.

The second binding specificity may target an antigen on the same cell as LPAR1 or on a different cell of the same tissue type or of a different tissue type. In certain embodiments, the target epitope may be on a different cell including a different T-cell, a B-cell, a tumour cell, an autoimmune tissue cell or a virally infected cell. Alternatively, the target epitope may be on the same cell.

In one embodiment, the construct comprises a polypeptide which binds to a target other than LPAR1.

Immunoconjugates

The polypeptides (such as antibodies or fragments thereof) of the present invention, may be conjugated to a therapeutic moiety, such as a cytotoxin or a chemotherapeutic agent. Most preferably the polypeptide is conjugated to a therapeutic moiety which is an anti-fibrotic. Such conjugates may be referred to as immunoconjugates. As used herein, the term "immunoconjugate" refers to an antibody or fragment thereof which is chemically or biologically linked to another moiety, such as a cytotoxin, a radioactive agent, a cytokine, an interferon, a target or reporter moiety, an enzyme, a toxin, a peptide or protein or a therapeutic agent. Most preferably the therapeutic agent is an anti-fibrotic. The antibody or fragment thereof may be linked to the cytotoxin, radioactive agent, cytokine, interferon, target or reporter moiety, enzyme, toxin, peptide or therapeutic agent at any location along the molecule so long as it is able to bind its target. Examples of immunoconjugates include antibody-drug conjugates and antibody-toxin fusion proteins. In one embodiment, the agent may be a second different antibody to LPAR1. In certain embodiments, the antibody may be conjugated to an agent specific for a tumor cell or a virally infected cell. The type of therapeutic moiety that may be conjugated to the anti-LPAR1 antibody will take into account the condition to be treated and the desired therapeutic effect to be achieved.

Polynucleotides and Expression Vectors

In one aspect of the invention there is provided a polynucleotide encoding the polypeptide of the invention.

In one aspect of the invention there is provided a polynucleotide comprising or consisting of a sequence having at least 70%, such as at least 80%, such as at least 90%, such as at least 95%, such as at least 99% sequence identity with a polynucleotide encoding any one of the portions of SEQ ID NOs: 1 to 22, 40 to 55, 72 to 95, 98, 100, 101, 103, and 107 to 112 which encodes HCDR1, HCDR2, HCDR3, LCDR1, LCDR2, LCDR3, HFR1, HFR2, HFR3, HFR4, LFR1, LFR2, LFR3 or LFR4 of the encoded immunoglobulin chain variable domain.

In one aspect of the invention the polynucleotide comprises any one of SEQ ID NOs: 1368 to 1374.

To express the polypeptide, polynucleotides described herein may be inserted into expression vectors such that the genes are operatively linked to transcriptional and translational control sequences (which may be termed an 'expression cassette' as well understood in the art). Therefore, in one aspect of the invention there is provided an expression vector comprising a polynucleotide sequence of the invention as defined herein.

The present invention also provides polynucleotide sequences and expression vectors and plasmids encoding all of the polypeptide sequences disclosed herein, including any variant polypeptide sequences disclosed herein optionally comprising one or more amino acid substitutions.

Mutations can be made to the DNA or cDNA that encode polypeptides which are silent as to the amino acid sequence of the polypeptide, but which provide preferred codons for translation in a particular host. The preferred codons for translation of a nucleic acid in, e.g., *E. coli* and *S. cerevisiae*, as well as mammalian, specifically human, are known.

Mutation of polypeptides can be achieved for example by substitutions, additions or deletions to a nucleic acid encoding the polypeptide. The substitutions, additions or deletions to a nucleic acid encoding the polypeptide can be introduced by many methods, including for example error-prone PCR, shuffling, oligonucleotide-directed mutagenesis, assembly PCR, PCR mutagenesis, in vivo mutagenesis, cassette mutagenesis, recursive ensemble mutagenesis, exponential ensemble mutagenesis, site-specific mutagenesis, gene reassembly, artificial gene synthesis, Gene Site Saturation Mutagenesis (GSSM), synthetic ligation reassembly (SLR) or a combination of these methods. The modifications, additions or deletions to a nucleic acid can also be introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, ensemble mutagenesis, chimeric nucleic acid multimer creation, or a combination thereof.

In particular, artificial gene synthesis may be used. A gene encoding a polypeptide of the invention can be synthetically produced by, for example, solid-phase DNA synthesis. Entire genes may be synthesized de novo, without the need for precursor template DNA. To obtain the desired oligonucleotide, the building blocks are sequentially coupled to the growing oligonucleotide chain in the order required by the sequence of the product. Upon the completion of the chain assembly, the product is released from the solid phase to solution, deprotected, and collected. Products can be isolated by high-performance liquid chromatography (HPLC) to obtain the desired oligonucleotides in high purity.

Expression vectors include, for example, plasmids, retroviruses, cosmids, yeast artificial chromosomes (YACs) and Epstein-Barr virus (EBV) derived episomes. The polynucleotide is ligated into a vector such that transcriptional and translational control sequences within the vector serve their intended function of regulating the transcription and translation of the polynucleotide. Expression and/or control sequences can include promoters, enhancers, transcription terminators, a start codon (i.e. ATG) 5' to the coding sequence, splicing signals for introns and stop codons. The expression vector and expression control sequences are chosen to be compatible with the expression host cell used. Thus, the invention further provides a nucleotide sequence encoding polypeptides of the invention comprising a VH region and a VL region joined by a synthetic linker (encoding SEQ ID NO: 69). It will be understood that polynucleotides or expression vectors of the invention may comprise the VH region, the VL region or both (optionally including the linker). Therefore, polynucleotides encoding the VH and VL regions can be inserted into separate vectors, alternatively sequences encoding both regions are inserted into the same expression vector. The polynucleotide(s) are inserted into the expression vector by standard methods (e.g., ligation of complementary restriction sites on the polynucleotide and vector, or blunt end ligation if no restriction sites are present).

A convenient vector is one that encodes a functionally complete CH and/or CL immunoglobulin sequence, with appropriate restriction sites engineered so that any VH or VL sequence can be easily inserted and expressed, as described herein. The expression vector can also encode a signal peptide that facilitates secretion of the polypeptide from a host cell. The polynucleotide may be cloned into the vector such that the signal peptide is linked in-frame to the amino terminus of the polypeptide. The signal peptide can be an immunoglobulin signal peptide or a heterologous signal peptide (i.e., a signal peptide from a non-immunoglobulin protein).

In one aspect of the invention there is provided a cell (e.g. a host cell) comprising the polynucleotide or expression vector as defined herein. It will be understood that the cell may comprise a first vector encoding the light chain of the polypeptide, and a second vector encoding the heavy chain of the polypeptide. Alternatively, the heavy and light chains may both be encoded on the same expression vector introduced into the cell.

In one embodiment, the polynucleotide or expression vector encodes a membrane anchor or transmembrane domain fused to the polypeptide, wherein the polypeptide is presented on an extracellular surface of the cell.

Transformation can be by any known method for introducing polynucleotides into a host cell. Methods for introduction of heterologous polynucleotides into mammalian cells are well known in the art and include dextran-mediated transfection, calcium phosphate precipitation, polybrene-mediated transfection, protoplast fusion, electroporation, transduction, encapsulation of the polynucleotide(s) in liposomes, biolistic injection and direct microinjection of the DNA into nuclei. In addition, nucleic acid molecules may be introduced into mammalian cells by viral vectors.

Mammalian cell lines available as hosts for expression are well known in the art and include many immortalized cell lines available from the American Type Culture Collection (ATCC). These include, inter alia, Chinese hamster ovary (CHO) cells, NSO, SP2 cells, HeLa cells, baby hamster kidney (BHK) cells, monkey kidney cells (COS), human hepatocellular carcinoma cells (e.g., Hep G2), A549 cells, 3T3 cells, and a number of other cell lines. Mammalian host cells include human, mouse, rat, dog, monkey, pig, goat, bovine, horse and hamster cells. Cell lines of particular preference are selected through determining which cell lines have high expression levels. Other cell lines that may be used are insect cell lines, such as Sf9 cells, amphibian cells, bacterial cells, plant cells and fungal cells. Antigen-binding fragments of antibodies such as the scFv and Fv fragments can be isolated and expressed in *E. coli* using methods known in the art.

The polypeptides are produced by culturing the host cells for a period of time sufficient to allow for expression of the polypeptide in the host cells or, more preferably, secretion of the polypeptide into the culture medium in which the host cells are grown. Polypeptides can be recovered from the culture medium using standard protein purification methods.

Polypeptides of the invention can be obtained and manipulated using the techniques disclosed for example in Green and Sambrook, Molecular Cloning: A Laboratory Manual (2012) 4th Edition Cold Spring Harbour Laboratory Press.

Monoclonal antibodies can be produced using hybridoma technology, by fusing a specific antibody-producing B cell with a myeloma (B cell cancer) cell that is selected for its ability to grow in tissue culture and for an absence of antibody chain synthesis.

A monoclonal antibody directed against a determined antigen can, for example, be obtained by:

a) immortalizing lymphocytes obtained from the peripheral blood of an animal previously immunized with a determined antigen, with an immortal cell and preferably with myeloma cells, in order to form a hybridoma, b) culturing the immortalized cells (hybridoma) formed and recovering the cells producing the antibodies having the desired specificity.

Alternatively, the use of a hybridoma cell is not required. Antibodies capable of binding to the target antigens as described herein may be isolated from a suitable antibody library via routine practice, for example, using the phage display, yeast display, ribosomal display, or mammalian display technology known in the art. Accordingly, monoclonal antibodies can be obtained, for example, by a process comprising the steps of:

a) cloning into vectors, especially into phages and more particularly filamentous bacteriophages, DNA or cDNA sequences obtained from lymphocytes especially peripheral blood lymphocytes of an animal (suitably previously immunized with determined antigens), b) transforming prokaryotic cells with the above vectors in conditions allowing the production of the antibodies, c) selecting the antibodies by subjecting them to antigen-affinity selection, d) recovering the antibodies having the desired specificity.

Optionally, an isolated polynucleotide encoding a polypeptide as described herein and which binds to LPAR1 can also be readily manufactured to make sufficient quantities to be employed as a medicament to ameliorate the signs or symptoms of disease. When employed as a medicament in this manner, typically the polynucleotide of interest is first operatively linked to an expression vector or expression cassette designed to express said antibody or fragment thereof in a subject or patient. Such expression cassettes and methods of delivery of polynucleotides or what are sometime termed 'nucleic-based' medicaments and are well known in the art. For a recent review see Hollevoet and Declerck (2017).

Also provided is a method for the production of a polypeptide, anti-LPAR1 antibody or fragment or variant thereof, comprising culturing a host cell of the invention in a cell culture medium under conditions to express the encoding nucleic acid sequence of the plasmid or vector inside the cell. The method may further comprise obtaining the polypeptide, anti-LPAR1 antibody or fragment or variant thereof from the cell culture supernatant. The obtained antigen-binding molecule may then be formulated into a pharmaceutical composition. Further, there is provided a method of producing a cell that expresses a polypeptide, anti-LPAR1 antibody or fragment or variant thereof, comprising transfecting said cell with a plasmid or vector of the invention. Said cells can then be cultured for the production of the polypeptide, anti-LPAR1 antibody or fragment or variant thereof.

Lysophosphatidic Acid Receptor 1 (LPAR1)

Lysophosphatidic acid (1-acyl-2-hydroxy-sn-glycero-3-phosphate; LPA) belongs to a family of endogenous lipid molecules that exert their effects through interactions with the LPA family of G protein-coupled receptors (GPCRs), of which there are currently 6 identified receptor subtypes. LPAR1-3 receptors belong to the endothelial differentiation gene (EDG) family GPCRs, and LPAR4-6 receptors are closely related to the purinergic family GPCRs. The LPAR1 receptor predominantly signals via Gi/o to inhibit cAMP production and Gq/11 to promote calcium mobilization, though also signals through G12/13 to activate the Rho GTPase nucleotide exchange factors (GEF).

LPAR1 may also be referred to as LPA-1, LPA receptor 1, Lysophosphatidic acid receptor 1 or Lysophosphatidic acid receptor Edg-2.

The crystal structure of LPAR1 was solved in 2015 (Chrencik et al. 2015). It exhibits many of the features typical of a family A GPCR, with 7 transmembrane helices, and 94 of the total of 364 amino acids facing the extracellular solvent. This includes an N terminal region 50 amino acids long. Unusually however the N-terminus forms a helical cap on the extracellular side, which folds over the 7-helix bundle to almost entirely occlude the ligand-binding site and bury the ligand. Human LPAR1 shares 99%, 99%, 97% and 97% amino acid identity with its orthologues in cynomolgus, rhesus, mouse and rat, respectively.

The extracellular region of LPAR1 comprises extracellular domains 0 to 3 (ECD0 to ECD3). In ECD0, the N-terminal region, residues 25-50 of SEQ ID NO: 62 form an unusual capping helix, held in place by a disulphide bridge between ECD0 and ECD2. By reference to SEQ ID NO: 62, the entire N-terminus is residues 1-50, the N-terminal capping helix is residues 25-50, the entire ECD1 is residues 106-121, the entire ECD2 is residues 185-204 and the entire ECD3 is residues 280-294.

In one embodiment the LPAR1 is human LPAR1. In one embodiment the LPAR1 is not human LPAR1. The LPAR1 may be native LPAR1 and/or full length LPAR1. Alternatively, the LPAR1 is a fragment of LPAR1, such as a fragment comprising one or more extracellular regions of LPAR1. In certain embodiments the fragment of LPAR1 is at least 50 amino acids long, such as at least 100 amino acids long, such as at least 150 amino acids long, such as at least 200 amino acids long, such as at least 250 amino acids long, such as at least 300 amino acids long, such as at least 350 amino acids long.

Suitably the LPAR1 comprises or consists of a sequence having at least 60%, such as at least 70%, such as at least 80%, such as at least 90%, such as at least 95%, such as at least 99% identity with SEQ ID NO: 62, SEQ ID NO: 63 or SEQ ID NO: 64. More suitably the LPAR1 comprises or consists of SEQ ID NO: 62, SEQ ID NO: 63 or SEQ ID NO: 64.

In one embodiment the LPAR1 is functionally active LPAR1. By 'functionally active' it is meant that the LPAR1 is capable of signalling via downstream signalling pathways (e.g. cAMP, Ca mobilisation). The binding of LPA to functionally active LPAR1 results in the transduction of downstream signalling, and/or functionally active LPAR1 maintains a constitutive level of downstream signalling. Non-functionally active LPAR1 is not capable of initiating signalling.

In a further embodiment, the LPAR1 is localised on the extracellular surface. In a further embodiment, the LPAR1 is present on the surface of a live cell. In a further embodiment, the polypeptide is an antagonist of LPAR1. In a further embodiment, the polypeptide is an antagonist of LPA mediated signalling.

Compositions

According to a further aspect of the invention, there is provided a composition comprising the polypeptide or construct as defined herein. In such embodiments, the composition may comprise the polypeptide or construct, optionally in combination with other excipients. Also included are compositions comprising one or more additional active agents (e.g. active agents suitable for treating the diseases mentioned herein).

According to a further aspect of the invention, there is provided a pharmaceutical composition comprising the polypeptide or construct as defined herein, together with a pharmaceutically acceptable diluent or carrier. The polypeptide or construct of the invention can be incorporated into pharmaceutical compositions suitable for administration to a subject. Typically, the pharmaceutical composition comprises a polypeptide or construct of the invention and a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, salts, phosphate buffered saline, dextrose, glycerol, ethanol and the like, as well as combinations thereof. In many cases, it will be preferable to include isotonic agents, for example, sugars, polyalcohols such as mannitol, sorbitol, or sodium chloride in the composition. Pharmaceutically acceptable substances such as wetting or minor amounts of auxiliary substances such as wetting or emulsifying agents, preservatives or buffers, which enhance the shelf life or effectiveness of the polypeptide may be included.

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions.

The preferred mode of administration is parenteral (e.g., intravenous, subcutaneous, intraperitoneal, intramuscular). In a preferred embodiment, administration is by intravenous infusion or injection. In another preferred embodiment, administration is by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration.

It is within the scope of the invention to use the pharmaceutical composition of the invention in therapeutic methods for the treatment of diseases as described herein as an adjunct to, or in conjunction with, other established therapies normally used in the treatment of such diseases.

In a further aspect of the invention, the polypeptide, composition or pharmaceutical composition is administered sequentially, simultaneously or separately with at least one active agent.

Treatment

Chronic Kidney Disease/Diabetic Kidney Disease (CKD/DKD)

Chronic kidney disease (CKD) can be caused by many factors, including diabetes, with 25-55% of all dialysis patients worldwide having diabetic kidney disease. CKD is characterised by progressive loss of kidney function. Clinically this is initially diagnosed by an estimated glomerular filtration rate (eGRF) of <60 mL/minute (a healthy adult eGFR is >90 mL/minute). The presence of protein in the urine (proteinuria), is an indicator of kidney damage and prognostic of a deterioration of eGFR.

No LPAR1 inhibitor has yet been tested in human kidney disease. Three published studies examine the effect of LPAR1 (or LPAR1 and LPAR3) inhibition on kidney function, in three separate models (Zhang et al. (2017), Li et al. (2017) & Lee J H et al. (2019)). All three studies found reduction in albuminuria, as well as in kidney fibrosis and inflammation. Various components of the LPAR1 signalling pathway have been found to be upregulated in different forms of kidney disease.

When CKD is associated with and caused by diabetes, it is known as diabetic kidney disease (DKD).

LPAR1 inhibitors have not previously been trialled in the treatment of DKD though there is significant evidence to link LPAR1 biology with clinical disease. While LPAR1 plays a role in a range of biological pathways and diseases including neuropathic pain, bone growth and cancer, it has particular importance in three biological axes which are at the core of kidney disease; fibrosis, inflammation and metabolic syndrome. These three axes exert specific and measurable changes to the levels of a number of biochemicals found in blood and urine. These dovetail with molecules found to be modulated by LPAR1 inhibition in a Phase II study (Palmer et al. 2018) and various animal studies.

LPAR1 genetic knockout or pharmacological inhibition has been protective in a number of models of mouse kidney fibrosis (Zhang et al., 2017; Pradère et al., 2007; Swaney et al. 2011). The Phase II efficacy trial for idiopathic lung fibrosis (Palmer et al. 2018) showed that the small molecule inhibitor of LPAR1 was effective in maintaining forced vital capacity over the study period.

LPAR1 plays a role in the induction of inflammation. Addition of LPA to whole blood triggers histamine release through LPAR1 (Swaney et al. 2010). In a murine molecule of vasculitis, recruitment of neutrophils to vascular walls for inflammation was dependent on LPAR1 expression on the neutrophils (Miyabe et al. 2019).

Increased signalling has through the LPA/LPAR1 axis has been linked to metabolic syndrome and cardiovascular health. Li et al. 2017 found that LPAR1 was selectively upregulated on a mouse kidney mesenchymal cell line after exposure to high glucose concentration. Rancoule et al. 2013 found that mice treated for three weeks with an LPAR1/3 inhibitor had improved tolerance to an i.p. injection of glucose. Guo et al. (2013) found that administration of exogenous adiponectin to db/db mice significantly reduced albuminuria and histological evidence of kidney fibrosis.

Three studies that examine the effect of LPAR1 (or LPAR1 and LPAR3) inhibition on kidney function have been published (Zhang et al. 2017, Li et al. 2017, Lee J H et al. 2019), which are summarised in Table 8.

TABLE 8

| Impact of LPAR1 inhibition on mouse models of diabetic nephropathy | | | |
|---|---|---|---|
| Study author: | Zhang et al. (2017) | Li et al. (2017) | Lee J H et al. (2019) |
| Diabetes model | db/db eNOS$^{2/2}$ (aggressive model) | db/db (moderate model) | STZ-induced (early disease model) |
| Duration of drug treatment | 12 weeks | 8 weeks | 8 weeks |
| LPAR1 Inhibitor | BMS-002 (LPAR1/3) | Ki16425 (LPAR1/3) | AM095 (LPAR1) |
| 24 h albuminuria vs untreated controls | ~65% reduction | ~30% reduction | ~30% reduction |

All three studies found reduction in albuminuria, kidney fibrosis and inflammation.

Conversely, upregulation of components of the LPAR1 signalling pathway has been found in different forms of kidney disease. Zhang et al. 2017 observed an increase in levels of autotaxin and LPAR1 in the kidneys of patients with diabetes. Sasagawa et al. 1998 observed a 2.6 fold increase in lysophosphatidic acid levels in the plasma of patients with renal failure compared to controls.

Peritoneal Fibrosis

Sakai et al. 2013 showed that genetic deletion of pharmacological inhibition of LPAR1 protected mice from fibrosis in response to CG peritoneal injury.

Liver Fibrosis

In a mouse model of NASH, treatment with an LPAR1 antagonist showed a strong decrease in the expression of fibrotic and inflammatory genes (Nishikawa et al. 2016). Correlation between the extent of liver fibrosis and plasma LPA level was shown in an in vivo mouse study in response to chronic liver injury (Watanabe et al. 2007)

Idiopathic Lung Fibrosis (IPF)

As described previously, the phase II clinical trial of IPF showed that a small molecule inhibitor of LPAR1 was effective in treating fibrosis of the lungs (Palmer et al. 2018). Furthermore, an in vivo mouse study using LPAR1 deficient mice found that LPAR1 deficiency protected the mice from fibrosis and mortality after a lung injury (Tager et al. 2007)

Dermal Fibrosis

Using a mouse model of bleomycin-induced dermal fibrosis, LPAR1 knockout mouse were found to be resistant to bleomycin-induced increases in dermal thickness and collagen (Castelino et al. 2011).

Systemic Sclerosis

Mass spectrometric analysis of the sera of systemic sclerosis patients found elevated levels of 2-arachidonoyl-LPA (Tokumura et al. 2009).

Osteoarthritis

Treatment with an LPAR1 antagonist caused decreased synovial inflammation, cartilage damage and bone erosion in mice (Orosa et al. 2014).

According to a further aspect of the invention, there is provided a polypeptide, construct or composition as defined herein for use as a medicament.

In one embodiment, the polypeptide, construct or composition is for use in therapy, particularly for use in the treatment of an inflammatory and/or fibrotic disease, or cancer. Suitably the polypeptide, construct or composition is for use in the treatment of an inflammatory and/or fibrotic disease. Suitably, the polypeptide, construct or composition is for use in the treatment of chronic kidney disease, kidney fibrosis, peritoneal fibrosis, liver fibrosis, pulmonary fibrosis (e.g. idiopathic pulmonary fibrosis), dermal fibrosis, systemic sclerosis or osteoarthritis. Suitably, the polypeptide is for use in the treatment of chronic kidney disease, such as diabetic kidney disease. Alternatively the polypeptide, construct or composition is for use in the treatment of chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer.

In a further embodiment, there is provided a method for treating a disease in a subject in need thereof, comprising administering the polypeptide, construct or composition as defined herein. In a further embodiment, there is provided a method for treating an inflammatory disease and/or fibrotic disease in a subject in need thereof, comprising administering the polypeptide, construct or composition as defined herein. In a further embodiment, there is provided a method for treating chronic kidney disease, kidney fibrosis, peritoneal fibrosis, liver fibrosis, pulmonary fibrosis (e.g. idiopathic pulmonary fibrosis), dermal fibrosis, systemic sclerosis or osteoarthritis comprising administering the polypeptide, construct or composition as defined herein. In a further embodiment, there is provided a method of treating chronic kidney disease, such as diabetic kidney disease comprising administering the polypeptide, construct or composition as defined herein. Alternatively there is provided a method of treating chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer comprising administering the polypeptide, construct or composition as defined herein.

According to further aspects of the invention, there is provided the use of a polypeptide, construct or composition as defined herein for the manufacture of a medicament, for the treatment of disease. According to further aspects of the invention, there is provided the use of a polypeptide, construct or composition as defined herein for the manufacture of a medicament, for the treatment of an inflammatory disease and/or fibrotic disease. In a further embodiment, there is provided the use of a polypeptide, construct or composition as defined herein for the manufacture of a medicament for the treatment of chronic kidney disease, kidney fibrosis, peritoneal fibrosis, liver fibrosis, pulmonary fibrosis (e.g. idiopathic pulmonary fibrosis), dermal fibrosis, systemic sclerosis or osteoarthritis. In a further embodiment, there is provided the use of a polypeptide, construct or composition as defined herein for the manufacture of a medicament for the treatment of chronic kidney disease, such as diabetic kidney disease. Alternatively there is provided the use of a polypeptide, construct or composition as defined herein for the manufacture of a medicament for the treatment of chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer.

In one embodiment, the polypeptide, construct or composition is administered in a therapeutically effective amount.

The present invention will now be further described by means of the following non-limiting examples.

EXAMPLES

Example 1: Methods 1.1 Immunisation Protocol

Mice were immunized with LPAR1. After immunisation spleens were dissected into DMEM and homogenised as described in Forbes et al. (2011). After red cells were lysed and splenocytes pelleted, splenocytes were resuspended in 1.5 mL FBS and refrigerated for 10 minutes before adding 1.5 mL 20% DMSO in FBS. Suspended cells were then aliquoted into cryovials and frozen at a rate of −1° C. per minute.

1.2 Hybridoma Isolation

Cryo-frozen spleen cells from immunized mice were defrosted and fused with sp2/0 myeloma cells using polyethene glycol to produce hybridomas. Hybridomas were then plated into methylcellulose medium gel and productive hybridomas were selected using HAT (hypoxanthine-aminopterin-thymidine) reagent. After 5 days, hybridoma colonies producing IgG were identified using CloneDetect reagent (Molecular Devices), and then picked and seeded into monoclonal cultures. LPAR1-reactive hybridomas were identified by screening culture supernatants for differential binding to LPAR1-expressing cells in a FACS assay. Briefly, CHO cells were transiently transfected with a plasmid to express either LPAR1 or an irrelevant GPCR, and two days after CHO cell transfection, hybridoma supernatants were mixed with both populations of CHO cells. Binding of antibody to cells was detected with an anti-mouse IgG secondary antibody. Hybridoma supernatants that bound CHO-LPAR1 cells but not CHO-irrelevant GPCR cells were defined as LPAR1 binders.

1.3 Ig Gene Isolation from Hybridoma $10^6$ LPAR1-specific hybridoma cells were subjected to total RNA extraction and reverse transcription to generate a whole cDNA library. Next generation sequencing of the entire cDNA library was performed on an Illumina HiSeq sequencer. Contigs were assembled, and mined for DNA sequences encoding antibody VH or VL sequences.

1.4 Generation of Recombinant Vectors

DNA fragments for VH or VL regions were cloned into the human IgG1 heavy chain or human Kappa light chain expression vectors using an overhang cloning method. Variable region sequences were optimised for *Homo Sapiens* and cloned into vectors via 5' BspEI and 3' BsaI or via 5' BssHII and 3' ApaI. Mini-scale DNA samples were reconstituted to 100 ng/μL in cell culture grade water. Plasmids were stored at −20° C. until needed for transfection.

1.5 Antibody Expression

For antibody expression, HEK293 cells were cultured at 37° C. at 8% $CO_2$ and seeded at a density of $2 \times 10^6$ cells. Heavy and light chain plasmids were transiently co-transfected into HEK293 cells. Enhancers were added 18-22 hours after transfection. Supernatants were harvested 5 days after transfection. Cells were pelleted by centrifugation at 1000 g for 10 minutes and supernatants were aliquoted into appropriate sterile plasticware.

1.6 Antibody Purification

Recombinantly expressed human antibodies were purified from cell culture supernatants using Protein-A, 5 mL gravity flow columns. Prior to sample loading, the column was equilibrated with Protein A IgG Binding Buffer, pH 8.0. Cell culture supernatants were clarified using 0.45 μM filters and mixed with 1:1 Protein A IgG Binding Buffer, pH 8.0. Upon passing the sample through the column, the flow-through was collected and passed over the column a subsequent 5 times. The columns were washed with PBS and 0.5M L-arginine buffer, pH 7. The antibody was eluted from the column into 1M Tris-HCl, pH 8.0, using IgG elution buffer, pH 2.8. The eluted sample was buffer exchanged into PBS using centrifugal filter units and sterile filtered using 0.2 μM centrifuge tube filters. Purified antibodies were stored in PBS at 4° C.

1.7 HTRF cAMP Assay cAMP Hunter™ CHO-K1 EDG2 Gi/Gq cells (DiscoverX) were seeded in 384-well white plates at 3000 cells per 25 μL full growth medium and incubated for 24 hours at 37° C. The following day, cells were serum starved for 4 hours at 37° C. Following serum starvation, medium was discarded and replaced with 5 μL cell assay buffer (HBSS+ 0.1% (w/v) BSA+20 mM HEPES). Cells were stimulated with human antibodies or human antibody-containing supernatants at various concentrations and incubated for 15 minutes at 37° C. After pre-incubation, cells were stimulated with LPA (0.5 μM) and forskolin (5 μM) and incubated for 1 hour at 37° C. Following the manufacturer protocol, cAMP-cryptate and anti-cAMP-d2 working solutions were prepared in lysis and detection buffer and added to all wells of the plate. After incubation in the dark for 1 hour at room temperature, the plates were read on a plate reader. cAMP concentrations were determined using Prism 5 (GraphPad Software, CA, USA) by applying the 620/665 nm fluorescence ratios to a standard curve of known cAMP concentrations.

1.8 Calcium Mobilisation Assay

Human pulmonary fibroblasts were seeded at 8000 cells per well in 50 μL full growth medium into 384-well plates and incubated for 24 hours at 37° C. The following day, the media was changed to serum-free and incubated for 24 hours at 37° C. Following serum starvation, medium was replaced with Fluo-4 no wash dye (Molecular Devices) diluted in buffer (HBSS supplemented with 20 mM HEPES, 2.5 mM Probenecid, 0.1% (w/v) BSA, pH7.4) and equilibrated for 45 minutes at 37° C. The plate was transferred to the FLIPR for the calcium mobilization assay. Human antibodies or human antibody-containing supernatants were dispensed onto the plate at various concentrations, whilst recording, over 120 seconds and incubated for 20 minutes at 37° C. After pre-incubation, the EC80 concentration of ligand (100 nM LPA) was dispensed on-line, whilst recording, over 120 seconds. Data were collected in ScreenWorks version 3.2 (Molecular Devices) and the relative fluorescent units (RFU) plotted against the log of compound concentration using nonlinear regression analysis in Prism 5 (GraphPad Software, CA, USA).

1.9 HPF BrdU Incorporation Assay

Human pulmonary fibroblasts were seeded at 1500 cells/well in 35 μL assay medium (RPMI 1640+2 mM L-glutamine+0.1% (w/v) HSA+Penicillin-Streptomycin) into 384-well black view-plates. Cells were incubated for 24 hours at 37° C. The following day, cells were stimulated with human antibodies at various concentrations and incubated for 30 minutes at 37° C. After pre-incubation, cells were stimulated with LPA (10 μM) and incubated for 8 hours at 37° C. For the following steps, reagents from the Perkin Elmer DELFIA cell proliferation kit were used. Cells were treated with 10 μM BrdU labelling solution and incubated for 16 hours at 37° C. After 16 hours of BrdU incorporation, medium was removed and cells were fixed. After washing, anti-BrdU-EU working solution was added to the plate and incubated for a further 2 hours at room temperature. After further washing, the DELFIA inducer solution was added to all wells of the plate followed by 20 minutes of shaking incubation at room temperature. Time-resolved fluorescence was measured using a BMG LABTECH ClarioStar plate reader. Background levels of RFU were subtracted from the raw RFU values detected in each well and concentration-response curves fitted using a four-parameter logistic equation in Prism 5 (GraphPad Software, CA, USA).

1.10 HPF/HKF Migration Assay

Human pulmonary fibroblasts or human kidney fibroblasts were grown to 80% confluence in full growth medium in cell culture flasks. Prior to the experiment, the medium was replaced with serum free and the cells incubated for 24 hours at 37° C. The underside membrane of a 96-well transwell chamber (5 μM) was coated with 6.6 μg/mL fibronectin (diluted in water supplemented with 20 mM HEPES) and left to air dry in sterile conditions overnight. The next day, the other side of the chemotaxis membrane was coated with 6.6 μg/mL fibronectin as above. Assay buffer containing chemoattractant (LPA) was added to the lower chamber of the plate, then once dry, the fibronectin-coated membrane with 5 μM pore size was placed on top. Growth arrested fibroblasts were dissociated, washed and resuspended in RPMI 1640+0.1% (w/v) BSA, then $1 \times 10^5$ cells/well were loaded into the upper chamber. Human antibodies were diluted in assay buffer (RPMI 1640+0.1% (w/v) BSA) and added to the cell suspension in the upper chamber. After a 24 hour incubation at 37° C., fibroblasts on the top side of the membrane were removed using tapered-ended cotton swabs so that only cells that had migrated through the membrane remained. The membrane was fixed with 100% methanol for 10 minutes, stained with DAPI for 10 minutes and rinsed with distilled water. The membrane chamber was mounted onto clear plasticware and the cells on the underside were counted using a fluorescence microscope at ×10 magnification and images taken.

1.11 Transient-Transfection CIFAT

CHO-K1 cells were seeded in clear 96-well plates at 20,000 cells per 200 μL full growth medium and incubated for 24 hours at 37° C. The following day, in a sterile tube, 0.0309 uL/well PEI (Generon, MW 160,000) was diluted into 10 uL/well transfection medium (DMEM supplemented with 2 mM L-glutamine and Penicillin-Streptomycin). The diluted PEI was added to 100 ng/well DNA encoding the target protein (human LPAR1 (SEQ ID NO: 62) unless otherwise stated), before vortexing immediately and incubating the mixture for 10 minutes at room temperature. 200 μL/well full growth medium was added to the PEI-DNA mixture, then medium in wells was taken off and 200 ul full growth medium/PEI/DNA mixture was added in the wells of the adherent cell plate. The plate was incubated for 24 hours at 37° C. The next day, the medium was discarded and replaced with 200 μL full growth medium. The plate was incubated for 24 hours at 37° C. The following day, medium was removed from the wells and the cells incubated with primary antibody at varying concentrations for 75 minutes at 37° C. After washing and cell fixation with 4% PFA, the binding of the antibodies was detected using a goat anti-human Alexa Fluor 488 detection antibody (Invitrogen), incubated for 1 hour at room temperature. Fluorescence at 488 nm was measured using a BMG LABTECH ClarioStar plate reader and microscopy images were taken at 10× magnification.

1.12 Stable-Cell CIFAT

CHO-LPAR1 and CHO-CXCR2 cells were seeded in black 96-well plates at a total of 50,000 cells/200 μL full growth medium at a ratio of 2:23. Cells were incubated for 24 hours at 37° C. The following day, the medium was removed from the wells and the cells incubated with primary antibody at varying concentrations for 75 minutes at 37° C. After washing and cell fixation with 4% PFA, the binding of the antibodies was detected using a goat anti-human Alexa Fluor 488 detection antibody (Invitrogen), incubated for 1 hour at room temperature. Fluorescence at 488 nm was measured using a BMG LABTECH ClarioStar plate reader and microscopy images were taken at 10× magnification.

1.13 Competition CIFAT

CHO-LPAR1 (GenScript) cells were seeded in black 96-well plates at 50,000 cells/200 μL full growth medium at and incubated for 24 hours at 37° C. The following day, the medium was removed from the wells and the cells incubated with 100 μg/mL primary antibody for 20 minutes at 37° C. After pre-incubation with the antibody, 10 μg/mL biotinylated competing antibody was added before incubation for 20 minutes at 37° C. After washing and cell fixation with 4% PFA, the binding of the antibodies was detected using an Alexa Fluor 488 streptavidin detection antibody (Molecular Probes), incubated for 45 minutes at 4° C. Fluorescence at 488 nm was measured using a BMG LABTECH ClarioStar plate reader and microscopy images were taken at 10× magnification.

1.14 $K_D$ Measurement

The monomeric affinity constant $K_D$ for the interaction of antibodies with LPAR1 was determined using monomeric Fabs derived from the antibodies, using the KinExA method. In this method, the concentration of unbound antibody is measured against a range of antigen concentrations. Because $K_D$=([Free antigen][Free antibody])/[Antigen-antibody complex], the value of $K_D$ can be deduced from these measurements. CHO-LPAR1 cells, the antigen source, are titrated in a background of constant binding partner (CBP, e.g. a Fab to be tested). Samples are gently rocked until equilibrium is reached. After incubation, cells are centrifuged and the free CBP is removed without disturbing the cell pellet. Beads coated with Anti-Species are used to capture a portion of free CBP. Captured CBP is detected with a fluorescently labelled Anti-CBP using the KinExA. The fluorescent signal is converted to a voltage signal that is directly proportional to the concentration of free CBP in the equilibrated sample.

Values of $K_D$ in the present application are provided using Fab formatted antibodies.

1.15 BRET Assay

Using polyethylenimine (PEI) transfection agent at a 3:1 ratio, HEK293 cells were co-transfected in suspension with hLPAR1 and one of the following biosensors: G protein activation sensors ($G\alpha i2$, $G\alpha 13$, and $G\alpha q$) and the $\beta$Arrestin 2-PM recruitment biosensor (+GRK2). Cells were directly seeded in 96-well plates immediately following transfection at a density of 35,000 cells/well. 48 hours post-transfection, BRET experiments were performed in both agonist and allosteric/antagonist mode. Using a plate washer, culture medium was aspirated and replaced with 30 μl of Hank's Balanced Salt Solution buffer (HBSS). Plates were equilibrated at room temperature for 60 minutes. For agonist testing, serial dilutions of the antibodies were performed in PBS and then added to each well. Antibodies were assayed at 12 concentrations in technical duplicates. Small molecules were added to each relevant well. Small molecules were assayed at 22 concentrations with each biosensor. Cells were then incubated with the antibodies or small molecules at room temperature for 60 or 10 minutes, respectively. 10 μl of 10 μM e-Coelenterazine Prolume Purple (Nanolight) was then added to each well. Cells were incubated at room temperature for an additional 10 minutes. BRET readings were then collected with a 0.4 sec integration time on a plate reader (filters: 400 nm/70 nm, 515 nm/20 nm). For allosteric testing (after agonist testing), an EC75 of the endogenous ligand (oleoyl-LPA) was added to each well already containing antibody or small molecule. Cells were incubated at room temperature for an additional 10 minutes. BRET readings were then collected with a 0.4 sec integration time on a plate reader (filters: 400 nm/70 nm, 515 nm/20 nm). BRET signals were determined by calculating the ratio of light emitted by GFP-acceptor (515 nm) over light emitted by luciferase-donor (400 nm). All BRET ratios were standardized with pre-established BRET values for positive and negative controls. The standardized BRET ratio is referred to as universal BRET (uBRET). Resulting dose-response curves were fitted using the three- or four-parameter logistic non-linear regression model in GraphPad Prism 9.

1.16 Rat Pharmacokinetics

The rat pharmacokinetics study was carried out in male Sprague Dawley rats (275-325 g). Rats received an IV slow bolus (3 mg/kg) of test antibody. Blood samples were taken at the following time-points: pre-dose, 2 min, 1 hour, 3 hours, 6 hours, 24 hours, 48 hours, 96 hours, 7 days, 14 days and 21 days after dosing. For each animal and for each blood sampling, 200 μL venous blood was obtained from the sublingual vein under isoflurane anaesthesia in K2EDTA vials. The blood samples were gently mixed, placed immediately on crushed ice and centrifuged within 30 min of sampling at approximately 1500×g for approximately 10 min at approximately 4° C. For each blood sample, the resulting plasma was separated into 2 aliquots of 30 μL and transferred, using disposable plastic material, into polypropylene tubes with conical bottom and stored at −80° C. until analysis by capture ELISA. Plates were coated overnight with 1 μg/mL capture IgG before washing and blocking with 3% (w/v) milk the next morning for 2 hours. Plasma dilutions were incubated on the plates for 2 hours at room temperature. Plates were washed with PBS+0.05% tween 20 (PBST) before incubation with anti-human Fc HRP-conjugated secondary detection antibody (1:5000 in PBST) for 1 hour at room temperature. After washing, wells are incubated with TMB substrate for 15 minutes at room temperature before addition of 1M sulphuric acid. Absorbance was measured on a plate reader at 450 nm. Antibody concentrations were calculated using interpolation off a standard curve constructed for each individual test IgG in Prism 5 (GraphPad Software, CA, USA). Interpolated data was analysed using Phoenix WinNonlin® version 8.1 (Certara USA, Inc., Princeton, NJ) to extract relevant PK parameters.

Example 2: Identification of Anti-LPAR1 Antibodies, Determination of Germline Sequences and Identification of Clonally-Related Hybridomas Mice were immunized as described in Example 1.1. A hybridoma producing an antibody specific to LPAR1 was isolated as described in Example 1.2. The antibody against LPAR1 produced by the hybridoma was sequenced using the method of Example 1.3 (Antibody 1). The variable domains of Antibody 1 were sequenced. The sequences are shown in in SEQ ID NO: 23 (VH) and 24 (VL).

The sequence of Antibody 1 was analysed to deduce the murine germline sequence the antibody was derived from (SEQ ID NO: 25 (VH) and 26 (VL), Antibody 2). Antibody 2 was produced and expressed, and then tested for LPAR1 binding affinity. Antibody 2 had extremely low binding affinity for LPAR1.

Antibody 3 was then designed, wherein the variable regions consist of the CDR regions of Antibody 1 and the framework regions of Antibody 2, shown in SEQ ID NOs: 27 (VH) and 28 (VL).

Hybridomas related to Antibody 1 were identified, which had also derived from the murine germline sequence of Antibody 2. One such hybridoma was Antibody 4 (SEQ ID NOs: 29 (VH) and 30 (VL)) which comprised a mutation in LCDR3 which was not present in Antibody 1 (Q90H).

The VL domain of Antibody 3 was then altered to include the Q90H mutation (Antibody 5, SEQ ID NOs: SEQ ID NO: 27 (VH) and 31 (VL)). This antibody had improved affinity and expression compared to the original Antibody 1 clone.

A further hybridoma producing antibodies specific to LPAR1 was also isolated. The further antibody (63D8) was sequenced using the method of Example 1.3. The VH and VL sequences of the antibody are shown in SEQ ID NOs: 113 (63D8 VH) and 114 (63D8 VL).

All antibodies referred to herein comprised the human kappa light chain constant region and the IgG1 heavy chain constant region (unless otherwise stated). For some antibodies, silencing mutations were introduced into the Fc region and/or IgG2 or IgG4 subtypes were produced.

Example 3: Humanisation and Affinity Maturation

Multiple humanised variants of Antibody 1 were produced, of which Antibody 7 (SEQ ID NOs: 33 (VH) and 34 (VL)) was the best in terms of expression, stability and function. The sequence of an alternate variant Antibody 14 (SEQ ID NOs: 96 (14 VH) and 97 (14 VL)) is also provided.

Mutated versions of Antibody 5 were produced, wherein each residue of the CDRs which has been deduced to be a product of somatic hypermutation was reverted to corresponding a murine germline residue. In most cases, reversion of these residues was found to be detrimental to the high-affinity binding properties of Antibody 5. The exception was a mutation within LCDR3, wherein reversion to Serine (N93S) resulted in a large affinity gain (Antibody 6, SEQ ID NOs: 27 (VH) and 32 (VL)).

A version of Antibody 7 was produced which comprised the two light chain mutations Q90H and N93S (Antibody 8, SEQ ID NOs: 33 (VH) and 39 (VL)).

A residue E61 within HCDR2 of Antibody 8 was diversified to all amino-acids bar cysteine. It was found that the mutation E61Q significantly enhanced the function (Antibody 9, SEQ ID NOs: 35 (VH) and 39 (VL)).

In parallel, phage display of Antibody 3 was conducted to randomise HCDR3. Two HCDR3 sequences were discovered (Antibody 10, SEQ ID NOs: 36 (VH) and 39 (VL) and Antibody 11 SEQ ID NOs: 37 (VH) and 39 (VL)). It was noticed that the overall charge of the heavy chain in Antibodies 10 and 11 was increased by 2 compared to Antibody 3. To eliminate the risk of non-specific interactions driven by this high positive charge, a mutation in LCDR2 (T56D) was produced (Antibody 12 SEQ ID NOs: 36 (VH) and 38 (VL) and Antibody 13 SEQ ID NOs: 37 (VH) and 38 (VL)). Antibody 12 and 13 had reduced propensity for non-specific interactions with minimal effect on affinity.

Example 4: Investigation of Antibody 12

Further experiments were conducted on Antibody 12.

Figure 1:
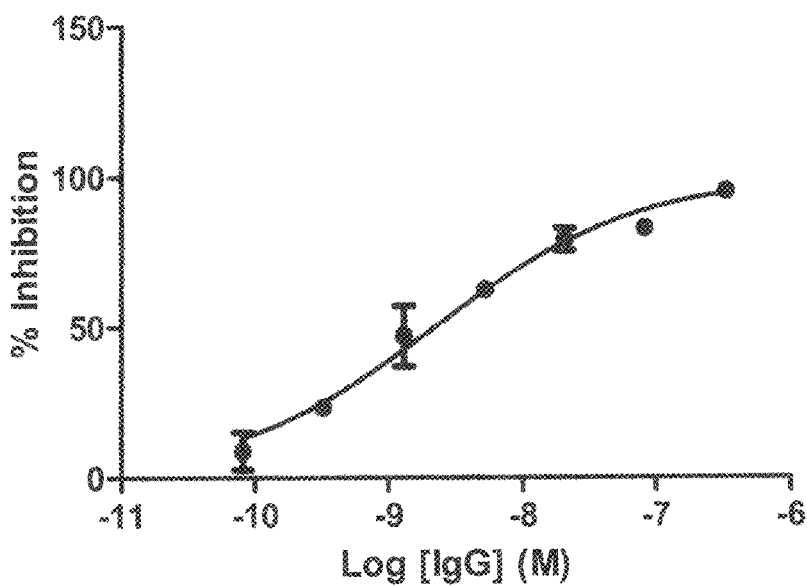
FIG. 1A-E—Antibody 12 expression level compared to an Adalimumab biosimilar, ability to bind to huLPAR1-HA cells, ability to increase cAMP signalling, ability to inhibit calcium signalling and ability to decrease cell proliferation

Antibody 12 was expressed by following method 1.5. The expression level was compared to an Adalimumab biosimilar (FIG. 1A). The ability of Antibody 12 to bind to huLPAR1-HA cells was assessed using the transient transfection CIFAT assay (method 1.11). The results are shown in FIG. 1B. The ability of Antibody 12 to increase cAMP signalling, inhibit calcium signalling and decrease cell proliferation was tested using methods 1.7, 1.8 and 1.9. The results are shown in FIGS. 1C-E. The $K_D$ of Antibody 12 was measured using method 1.14. It was found that Antibody 12 had a $K_D$ of 1.28 nM.

Example 5: Investigation of Antibody 13

The experiments described in Example 4 were also conducted on Antibody 13. The results are shown in FIGS. 2A (expression level compared to an Adalimumab biosimilar), 2B (ability to increase cAMP signalling), 2C (ability to inhibit calcium signalling) and 2D (ability to decrease cell proliferation). The $K_D$ of Antibody 13 was measured. It was found that Antibody 13 had a $K_D$ of 993 pM.

Example 6: Epitope Analysis

In Silico

The epitope of a variant of Antibody 7 (Antibody 7b, SEQ ID NOs: 418 (VH) and 39 (VL)) was elucidated in silico using SEQ ID NO: 64 as the sequence for LPAR1. SEQ ID NO: 64 is a modified, truncated version of LPAR1 (4Z35 LPAR1 crystal structure). Predicted epitope residues are shown in FIG. 3A (on the sequence) and FIG. 3B (on the 3D structure) using numbering based on SEQ ID NO: 64. Predicted epitope interaction regions 1 to 4 (SEQ ID NOs: 65 to 68) are shown in FIG. 3A and FIG. 3C.

The residues of the paratope of Antibody 7b were also predicted (FIG. 4). CDRs are underlined using Chothia definitions in FIG. 4.

It was also established by competition CIFAT (Example 1.13) that Antibody 1 and 63D8 compete for the same epitope (data not shown).

In Vitro

Figure 3:
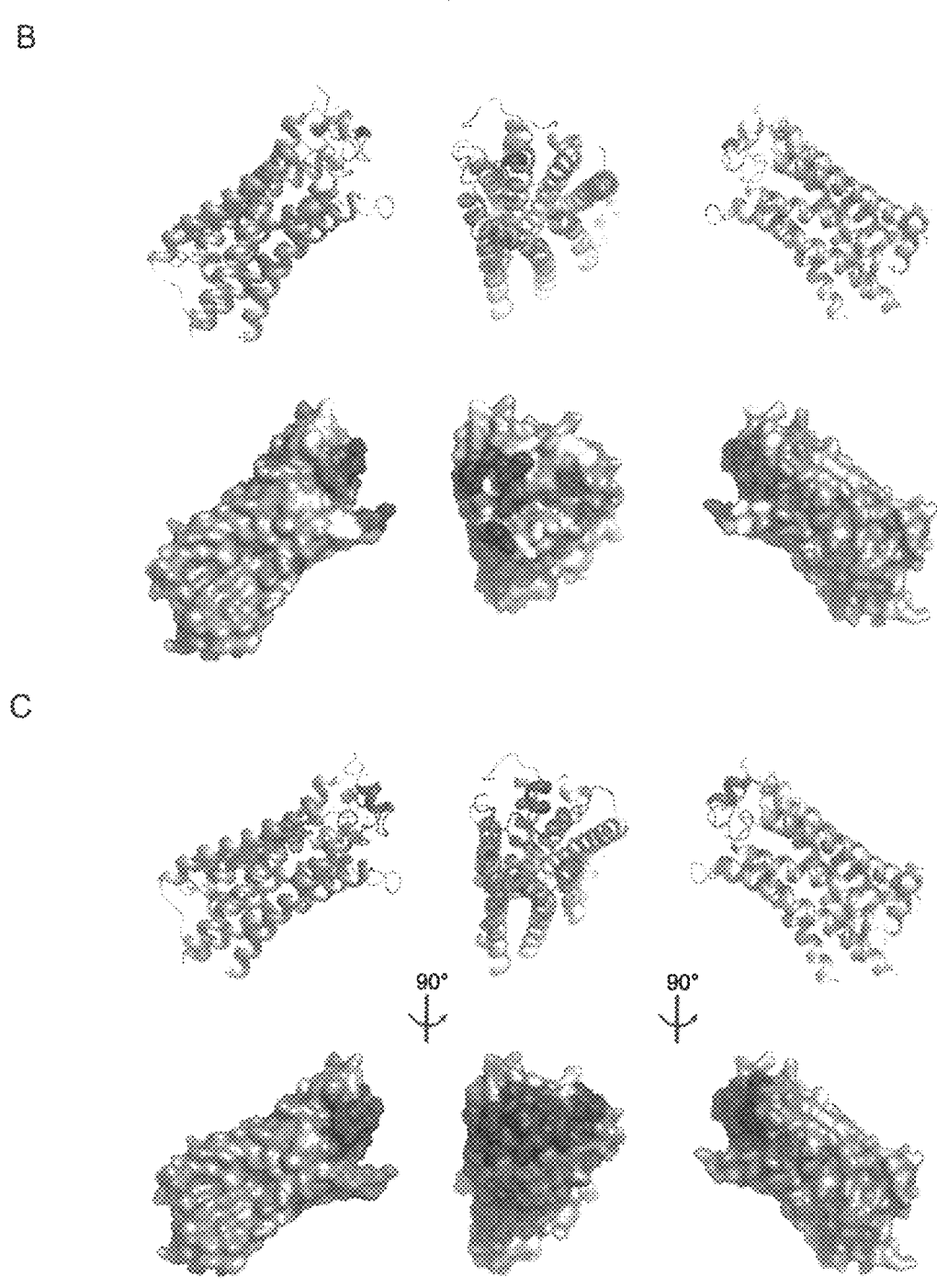

Based on the epitope analysis presented in FIGS. 3 and 4, constructs were designed to test the important residues/interaction regions predicted in silico. Plasmids containing the human LPAR1 sequence (sourced from UniProt) with selected single or multiple residue substitutions to alanine were used. CHO-K1 cells were transiently transfected with these plasm ids and the binding of an anti-LPAR1 mAb assessed to each of these receptor variants using protocol 1.11. The anti-LPAR1 mAb had the VH of SEQ ID NO: 369 and VL of SEQ ID NO: 39. Numbering of LPAR1 is based on UniProt Q92633 LPAR1 (SEQ ID NO: 62)

FIG. 5 shows the epitope residue involved, in silico prediction and fluorescence images of cells stained with anti-HA (expression control), anti-LPAR1 mAb and negative control mAb. Table 9 shows a summary of the epitope residue, extracellular domain location and whether the residue was found to be important for epitope binding.

TABLE 9

| | Epitope analysis | | |
|---|---|---|---|
| Position tested | Residue in human LPAR1 | Location | Epitope residue |
| 35 | N | N-terminus | Inconclusive |
| 36 | R | N-terminus | + |
| 43 | T | N-terminus | − |
| 44 | E | N-terminus | − |
| 114 | R | ECD1 | − |
| 115 | R | ECD1 | − |
| 193 | E | ECD2 | + |
| 194 | N | ECD2 | − |
| 286 | Q | ECD3 | Inconclusive |
| 289 | V | ECD3 | − |

FIG. 6 shows an updated version of FIG. 3B which includes labels for the identified critical residues involved in epitope binding. This work showed that residues 36R and 193E are involved in the binding of the antibody to LPAR1, with potential involvement from residues 35N and 286Q.

Example 7: Residue Substitution

Key residues in Antibody 1 derived LPAR1 binding antibodies discussed above (produced either in cell supernatant or as purified IgG) were substituted individually or in combination before analysing the impact on LPAR1 function. The residues chosen to be substituted are depicted as $X_n$ in the following sequences, wherein each CDR (wherein the CDRs in this example are defined by a non-Kabat numbering system) is underlined:

```
VH:
                              (SEQ ID NO: 70)
QVQLVQSGSELKKPGASVKVSCKASGYTFX₁X₂X₃X₄X₅X₆

WVRQAPGQGLEWX₇GX₈X₉X₁₀X₁₁X₁₂X₁₃X₁₄X₁₅X₁₆YX₁₇X₁₈

X₁₉FX₂₀GRFX₂₁X₂₂SADKSX₂₃STAYLQISSLKAEDTAVYX

₂₄CARDX₂₅X₂₆X₂₇X₂₈X₂₉X₃₀X₃₁X₃₂DYWX₃₃QGTTVTVSS

VL:
                              (SEQ ID NO: 71)
X₃₄IQMTQSPSSLSASVGDRVTITCX₃₅X₃₆X₃₇X₃₈X₃₉X₄₀X₄₁

X₄₂X₄₃X₄₄X₄₅WYQQKPGKAPKLLIYX₄₆AX₄₇X₄₈X₄₉X₅₀X₅₁GV

PSRFSGSGSGTDFTFTISSLQPEDIATYX₅₂CX₅₃X₅₄X₅₅X₅₆

X₅₇X₅₈PLX₅₉FGGGTKLEIK
```

89

The residues chosen to be substituted in the CDRs are depicted as $X_n$ in the following sequences (wherein the CDRs in this example are defined by a non-Kabat numbering system), wherein residues $X_{21}$ and $X_{23}$ may or may not be present. If present, $X_{21}$ and/or $X_{23}$ are selected from K and R. These residues were not present in these experiments.

HCDR1:
(SEQ ID NO: 72)

$X_1X_2X_3X_4X_5X_6$

HCDR2:
(SEQ ID NO: 76)

$X_7IX_8X_9X_{10}X_{11}X_{12}X_{13}X_{14}X_{15}YX_{16}X_{17}X_{18}FX_{19}IG$

HCDR3:
(SEQ ID NO: 80)

$DX_{20}X_{21}X_{22}X_{23}X_{24}X_{25}X_{26}X_{27}X_{28}X_{29}DY$

LCDR1:
(SEQ ID NO: 84)

$X_{30}X_{31}X_{32}X_{33}X_{34}X_{35}X_{36}X_{37}X_{38}X_{39}X_{40}$

LCDR2:
(SEQ ID NO: 88)

$X_{41}AX_{42}X_{43}X_{44}X_{45}X_{46}$

90

-continued

LCDR3:
(SEQ ID NO: 92)

$X_{47}X_{48}X_{49}X_{50}X_{51}X_{52}PLX_{53}$

The result of each substitution is depicted in Table 10 below, wherein "full length numbering" $X_n$ corresponds to the equivalent $X_n$ of SEQ ID NO: 70 or 71. The "CDR numbering" $X_n$ (if present) corresponds to the equivalent $X_n$ of SEQ ID NOs: 72, 76, 80, 84, 88 and 92. Substitutions were tested using the cAMP assay (method 1.7), with the exception of residues indicated with *. * indicates that these substitutions were tested using the stable-cell CIFAT assay (method 1.12). During this work it was found that for maximum affinity, one out of residues $X_{20}$, $X_{21}$ or $X_{22}$ is preferably R or K.

In addition, it was found that the lysine residue at position 74 of SEQ ID NO: 70 could be substituted with threonine, while still maintaining function in the stable-cell CIFAT assay (method 1.12). Function was maintained to such an extent that both lysine and threonine at position 74 of SEQ ID NO: 70 were considered 'Best Residues' according to the function categories given in Table 10.

The VH and VL sequences of the further antibodies produced in this work are provided in the accompanying sequence listing.

TABLE 10

Substitutions tested

| Full length numbering | CDR numbering | Residues tested | Best Residue(s) | 60-80% function of best residue | 40-60% function of best residue | 20-40% function of best residue | 0-20% function of best residue |
|---|---|---|---|---|---|---|---|
| X1 | X1 | E, S, Y, G, T, R, K, D, N | S, Y, T, G | R | E, K | D, N | |
| X2 | X2 | K, R, L, T, G, V, A, S, F, W, Q, M, Y, I, E, H, N, D, P | K, R, L, T, G, V, A, S, F, W, Q, M, Y | I, E | H , N | D, P | |
| X3 | X3 | K, R, L, T, G, V, A, S, F, W, Q, M, Y, I, E, H, N, D, P | R, K, H, T, S, F, G, V | A, L, N, Q | E, M, P, W | I | Y, D |
| X4 | X4 | A, G | A, G | | | | |
| X5 | X5 | M, I | M, I | | | | |
| X6 | X6 | K, R, L, T, G, V, A, S, F, W, Q, M, Y, I, E, H, N, D, P | S, E, G, D, L, T | N, Q, I, V, A | K, M | H, Y | F, P, R, W |
| X7 | | I, M | I, M | | | | |
| X8 | X7 | E, W | E | | | | W |
| X9 | X8 | D, Q, L, G, N | L, Q | | | D | G, N, *A, *Y |
| X10 | X9 | P, A, G, F, S, T, W, D, N, Q, Y | P, A, G | F, S | T | W | D, N, Q, Y |
| X11 | X10 | R, D, Q, K, W, N, A, E, G, H, I, K, S, T, Y, L | R | | | | D, Q, K, W, N, A, E, G, H, I, K, S, T, Y, L |
| X12 | X11 | S, T, D | S, T | | D | | *A |
| X13 | X12 | D, E, S, T, A, Y, R, G, N, W | G, R | S, Y, A, T | D, E, W | | N |
| X14 | X13 | Y, N, D, E | Y | | | | N, D, E, *A |
| X15 | X14 | T, P | T | | | | P, *A |
| X16 | X15 | N, H, S, T, D, E | N, H, S | | | | T, D, E, *A, *Y |
| X17 | X16 | R, N, F, K, Q, V, D, E, Y, G, M, P, W, H, L, I, S, T, A | R, N, F, K, Q, V, D, E | Y, G, M, P | W, H, L | I, S, T, *A | |
| X18 | X17 | K, R, L, T, G, V, A, S, F, W, Q, M, Y, I, E, H, N, D, P | Q, A, I, S, P, T, N, V | G, H, L, M, W, K, R, F | D, Y, E | | |
| X19 | X18 | K, R, L, T, G, V, A, S, F, W, Q, M, Y, I, E, H, N, D, P | G, D, E, H, L, V, Y, A, F, I, K, Q, W, R | M, P, S | | N | T |
| X20 | X19 | T, K, Q, E, R, M | T, K | Q, E, R, M | | | |
| X21 | | V, S | V, *S | | | | |
| X22 | | L, F | L, F | | | | |
| X23 | | S, A, V | S, A, V | | | | |
| X24 | | F, Y | F, Y | | | | |
| X25 | X20 | K, R, L, T, G, V, A, S, F, W, Q, M, Y, I, E, H, N, D, P | R, F, K, I | A, L, V, W, Y | M | P, Q, G, S | H, N, T, D, E |
| X26 | X22 | K, R, L, T, G, V, A, S, F, W, Q, M, Y, I, E, H, N, D, P | K, R, G | A, H, S, Q, T, P, M, W, Y | L, F, V | E, N | D, I |
| X27 | X24 | K, R, L, T, G, V, A, S, F, W, Q, M, Y, I, E, H, N, D, P | R, Y, A, H, P, L, K, G, Q, N, I, F, W | S, T, M, E, V | D | | |
| X28 | X25 | K, R, L, T, G, V, A, S, F, W, Q, M, Y, I, E, H, N, D, P | A, Q, T, S, G | V | R, I | H, K, P, L, M, F | D, N, W, Y, E |

TABLE 10-continued

| | | | | Substitutions tested | | | |
|---|---|---|---|---|---|---|---|
| Full length numbering | CDR numbering | Residues tested | Best Residue(s) | 60-80% function of best residue | 40-60% function of best residue | 20-40% function of best residue | 0-20% function of best residue |
| X29 | X26 | K, R, L, T, G, V, A, S, F, W, Q, M, Y, I, E, H, N, P | R | | S | | A, E, G, K, L, N, Q, T, V, W, Y, F, H, I, M, P |
| X30 | X27 | K, R, L, T, G, V, A, S, F, W, Q, M, Y, I, E, H, N, D, P | Y | | | H, Q, A | D, E, G, I, L, M, P, S, V, W, F, K, N, R, T |
| X31 | X28 | S, T, D, E, A | A, T, S | D | | E | |
| X32 | X29 | L, M | M | | L | | |
| X33 | | G, S | S | | G | | |
| X34 | | S, D, Q, E, N, A | S, D, Q, E, N, A | | | | |
| X35 | X30 | Q, K, R, S, T, G | Q, K, R, S, T | | | | G |
| X36 | X31 | A, S, T, G, L, R | A, S | T | | | G, L, R |
| X37 | X32 | S, D, T | S, T | D | | | G, N |
| X38 | X33 | Q, G, L, M, P, R, W, Y, A, D, E, F, S, T, V, N, H, I, K | Q, G, R, K, L, M, P, Y, S | A, N, H, W | D, E | F, T, I | V |
| X39 | X34 | S, D, G, H, I, L, N, T, V, Y | S, G, H, N | T, Y | | D | I, L, V |
| X40 | X35 | V, I, A, D, G, N, P, Q, R, S, T | V, A, I | | | | D, G, N, P, Q, R, S, T |
| X41 | X36 | R, S, A, D, G, I, K, N, S, T, V, Y | R | K, S | G | A | D, I, N, S, T, V, Y |
| X42 | X37 | Y, N, D, F, G, I, K, L, M, P, Q, S, E, H, T, R, V, W | Y, F, L, Q, S, H, T, G, I, M, V, W | K, N, R | | D, P | E |
| X43 | X38 | N, Y, A, D, F, G, H, L, Q, S, T, W | N, A, G, H, Q, S | | | Y, F, W | D, L, T |
| X44 | X39 | V, L, A, I, K, M, P, Y | V, I, M, L | | | | A, K, P, Y |
| X45 | X40 | A, N, D, E, G, H, Q, S, T, Y | A, G | D | | | N, E, H, Q, S, T, Y, |
| X46 | X41 | Y, A, D, G, I, K, L, M, N, P, Q, R, S, T, V, W, E, F, H | Y, H | R, T | A, D, K, L, N, Q | M, W, E, F, S | G, I, P, V |
| X47 | X42 | S, A, E, V, Y, D, F, G, H, I, K, L, M, N, P, Q, R, T, W | S, K, M, Q, R, V, Y, G, E | D, T, A, F, I, N, W | H | L | P |
| X48 | X43 | N, A, D, E, K, Q, R, S, T, Y | N, K, R | Q, T, Y, A, S | D, E | | |
| X49 | X44 | R, A, L, G, K, S | R, L, K | | | A | G, S |
| X50 | X45 | Y, A, E, N, P, Q, R, S, T, V, W, D, F, G, H, I, K, L, M | Y, I, K, M, Q, R, V, A, N, S, W, H | L, T, P, D, F | G | E | |
| X51 | X46 | T, A, Q, R, V, W, Y, F, S, D, E, G, H, I, K, L, M, N, P | T, A, D, E, Q, R, S, H, K, P, L, F, G, I, M, V | W, Y, N | | | |
| X52 | | F, Y | F, Y | | | | |
| X53 | X47 | Q, S, L | Q | S | L | | |
| X54 | X48 | Q, H, A, G, L, N, S, T, V | H, N, S, T | A, Q | | V | G, L |
| X55 | X49 | H, Y, A, D, F, G, L, R, S, T, W, Y | H | | | A, D, F | Y, G, L, R, S, T, W, Y |
| X56 | X50 | Y, L, D | Y | | L | | D |
| X57 | X51 | N, S, R, H, K, D, E, T, Q, P, I, L, M, F, W, Y, V, A, G | S, K, V | D, N, *R, *H, *T, *A, *G | *Q, *I, *M, *F, *W, *Y | *L | *E, *P |
| X58 | X52 | S, L, A, D, F, G, I, L, N, R, T, V, W, Y | S, A | | T, G | V, W, Y | L, D, F, I, N, R |
| X59 | X53 | T, Y | T | Y | | | |

Example 8: Antibody Substitutions and Investigation of Antibodies 15 to 18

Further optimised antibodies were created which include 'Best Residue' substitutions from Table 10. These include Antibody 15 (SEQ ID NOs: 36 (VH) and 99 (VL)), Antibody 16, Antibody 17 (SEQ ID NOs: 102 (VH) and 99 (VL)) and Antibody 18 (SEQ ID NOs: 102 (VH) and 104 (VL)).

To eliminate the risk of non-specific interactions driven by high positive charge, a mutation in LCDR2 (T56E) was introduced in Antibody 15. This mutation also eliminates the risk of isomerisation which occurred with the mutation T56D previously identified. Antibody 16 comprises the same VH and VL sequences as Antibody 15 (SEQ ID NOs: 36 and 99). The heavy chain constant region of Antibody 16 comprises different silencing mutations to that of Antibody 15.

Antibodies 15, 16, 17 and 18 were each expressed by following method 1.5. The expression levels were compared to a palivizumab biosimilar. The expression level of Antibody 15 is provided in FIG. 7A, the expression level of Antibody 16 is provided in FIG. 8A, the expression level of Antibody 17 is provided in FIG. 9A and the expression level of Antibody 18 is provided in FIG. 10A.

The ability of these antibodies to increase cAMP signalling was tested using method 1.7. The results for Antibody 15 are shown in FIG. 7B. The results for Antibody 16 are shown in FIG. 8B. The results for Antibody 17 are shown in FIG. 9B. The results for Antibody 18 are shown in FIG. 10B.

The ability of these antibodies to decrease cell proliferation was tested using method 1.9. The results for Antibody 15 are shown in FIG. 7C. The results for Antibody 16 are shown in FIG. 8C. The results for Antibody 17 are shown in FIG. 9C. The results for Antibody 18 are shown in FIG. 10C.

The ability of these antibodies to bind to huLPAR1-HA cells was assessed using the transient transfection CIFAT assay (method 1.11). The results for Antibody 15 are shown in FIG. 7D. The results for Antibody 17 are shown in FIG. 9D. The results for Antibody 18 are shown in FIG. 10D.

The $K_D$ of these antibodies was ascertained. The $K_D$ of Antibody 15 was 824 pM. The $K_D$ of Antibody 16 was also 824 pM. The $K_D$ of Antibody 17 was 1 nM and the $K_D$ of Antibody 18 was 1.39 nM.

Example 9: Comparison with Commercially Available Anti-LPAR1 Antibodies Using the CIFAT Assay Anti-LPAR1 antibodies of the invention were tested alongside commercially available anti-LPAR1 antibodies in the transient-transfection CIFAT assay for live cells (method 1.11) and in the transient-transfection CIFAT assay for fixed cells (method 1.11). The tested antibodies are listed in Table 11.

TABLE 11

| | Antibodies tested: | |
|---|---|---|
| Label | Source | Comments |
| Antibody 13 | Antibody of the invention | LPAR1-Significant fixed and live cell staining visible<br>Irrelevant GPCR-No significant cell staining visible |
| Antibody 12 | Antibody of the invention | LPAR1-Significant fixed and live cell staining visible<br>Irrelevant GPCR-No significant cell staining visible |
| EPR9710 | Abcam, ab232400 | LPAR1-Significant fixed cell staining visible, no significant live cell staining visible<br>Irrelevant GPCR-No significant cell staining visible |
| 4C3 | Thermo Fisher MA5-38395 | LPAR1-Significant fixed cell staining visible, no significant live cell staining visible<br>Irrelevant GPCR-No significant cell staining visible |
| #999807 | R&D Systems, MAB9963-100 | LPAR1-No significant cell staining visible<br>Irrelevant GPCR-No significant cell staining visible |
| 2E2 | Abnova, H00001902-M08 | LPAR1-No significant cell staining visible<br>Irrelevant GPCR-No significant cell staining visible |
| OTI1G6 | Thermo Fisher CF503737 | LPAR1-Significant fixed cell staining visible, no significant live cell staining visible<br>Irrelevant GPCR-No significant cell staining visible |
| 2H7 | Creative Diagnostics, DCABH-983 | LPAR1-Significant fixed cell staining visible, no significant live cell staining visible<br>Irrelevant GPCR-No significant cell staining visible |
| 63D8 | Antibody of the invention | LPAR1-Significant fixed and live cell staining visible<br>Irrelevant GPCR-No significant cell staining visible |
| Antibody 4 | Antibody of the invention | LPAR1-Significant fixed and live cell staining visible<br>Irrelevant GPCR-No significant cell staining visible |

63D8 comprises SEQ ID NO: 113 (VH) and 114 (VL).

The results are shown in FIGS. 11 and 12, wherein the scale bar represents 100 μm. FIG. 11 shows results of an experiment testing antibodies at 5 μg/mL against fixed/permeabilised cells, as well as at 5 μg/mL against live cells. FIG. 12 shows results of an experiment testing antibodies at 5 μg/mL against fixed/permeabilised cells, and at 20 μg/mL against live cells. These data illustrate that antibodies of the prior art do not bind LPAR1 on the surface of live cells, whereas a panel of antibodies according to the invention have been produced which bind LPAR1 on the surface of live cells.

Example 10: Allosteric Inhibition

The inhibition characteristics of Antibody 12 were investigated by Bioluminescence Resonance Energy Transfer (BRET, method 1.15) and compared to a small molecule LPAR1 inhibitor of the prior art (BMS-986020), see FIG. 13. The upper lines are values recorded with LPA present and the lower lines are values recorded with LPA not present. In the presence of LPA (upper line, FIG. 13A), the antibody does not deliver equivalent inhibition to the system where LPA is absent even at high concentrations (in this assay which measures the interaction of the G-protein G13 with the GPCR). This can only happen if the ligand (LPA) is also interacting with the receptor at the same time to enable some signalling. As the upper line flattens out at high concentrations, it can be assumed the system has reached maximal receptor occupancy and thus ligand is interacting with the receptor even when the antibody is at maximal occupancy. Thus, the antibody must be acting allosterically. A counter example is the prior art BMS-986020 molecule which is a competitive inhibitor and delivers 100% inhibition (in this assay), even in the presence of LPA (upper line, FIG. 13B).

Example 11: Species Cross-Reactivity

The species cross-reactivity of Antibodies 12, 15, 17 and 18 was investigated using transient-transfection CIFAT (method 1.11). Cells were transfected with DNA encoding human LPAR1, mouse LPAR1, guinea-pig LPAR1 or rabbit LPAR1 according to Table 12. The results are shown in FIG. 14A (Antibody 12), FIG. 14B (Antibody 15), FIG. 14C (Antibody 17) and FIG. 14D (Antibody 18).

TABLE 12

| | LPAR1 molecules tested | | |
|---|---|---|---|
| Species | Polypeptide SEQ ID NO: | cDNA SEQ ID NO: | UniProt |
| Human | 62 | 1229 | Q92633-1 |
| Mouse | 1222 | 1232 | P61793-1 |
| Guinea-pig | 1223 | 1233 | A0A286XEY5 |
| Rabbit | 1224 | 1234 | G1U0W0 |

Example 12: LPAR Isoform Specificity

The specificity of Antibodies 12, 15, 17 and 18 to human LPAR isoforms was investigated using transient-transfection CIFAT (method 1.11). Cells were transfected with DNA encoding human LPAR1, human LPAR2 or human LPAR3 according to Table 13. The results are shown in FIG. 15A (Antibody 12), FIG. 15B (Antibody 15), FIG. 15C (Antibody 17) and FIG. 15D (Antibody 18).

TABLE 13

| | LPAR isoforms tested | | |
|---|---|---|---|
| Isoform | Polypeptide SEQ ID NO: | cDNASEQIDNO: | UniProt |
| LPAR1 | 62 | 1229 | Q92633-1 |
| LPAR2 | 1225 | 1230 | Q9HBW0-1 |
| LPAR3 | 1226 | 1231 | Q9UBY5 |

Example 13: Rat Pharmacokinetics

The pharmacokinetics of Antibodies 12, 15, 17 and 18 in rats was investigated using method 1.16. A palivizumab biosimilar (SEQ ID NOs: 1227 (VH) and 1228 (VL)) was used as a control isotype antibody. The results are shown in FIG. 16.

Upon visual inspection, all 5 antibodies have the same plasma concentration-time profiles after single intravenous administration at 3 mg/kg. For all antibodies, the median tmax was observed at 0.3 hours, i.e. the first blood sampling time after administration. The mean Cmax observed after intravenous administration were between 143.8 µg/mL and 217.5 µg/mL for Antibody 17 and Antibody 12, respectively. Plasma concentrations decrease in a similar way for all antibodies, i.e. a first fast phase and a second slower one with quantifiable plasma concentrations until 504 hours after administration for all antibodies and all animals.

Example 14: SEC-MALS

Size exclusion chromatography using multiangle light scattering was conducted on Antibodies 12, 13, 15, 16, 17 and 18. The results are shown in FIG. 17A (Antibody 12), FIG. 17B (Antibody 13), FIG. 17C (Antibody 15), FIG. 17D (Antibody 16), FIG. 17E (Antibody 17) and FIG. 17F (Antibody 18).

Example 15: Liver Histopathology in Cynomolgus Monkeys

Small-molecule antagonist BMS-986020 showed efficacy in with patients with idiopathic pulmonary fibrosis (IPF) but showed off-target hepatobiliary toxicity. It was confirmed that the observed toxicity was compound-specific due to off-target binding to a number of hepatic bile acid efflux transporters (e.g., BSEP, MRP3 and MRP4) and not mediated via antagonism of LPAR1.

A dose range-finding study was carried out to determine the potential toxicity of Antibody 17 when given by the intravenous (infusion) route to cynomolgus monkeys. The test item, Antibody 17, was administered to 8 animals via intravenous infusion (30 minutes) on Day 1 (Group 1) or on Days 1, 8 and 15 (Groups 2 to 4). Animals were split by sex, allocated into 4 groups and dosed with Antibody 17 at 10, 33 or 100 mg/kg/day.

TABLE 14

| Experimental Design | | | |
| --- | --- | --- | --- |
| | Number of Animals | | Dosage Level |
| Group No. | Male | Female | (mg/kg/day) |
| 1 | 1 | 1 | 10 |
| 2 | 1 | 1 | 10 |
| 3 | 1 | 1 | 33 |
| 4 | 1 | 1 | 100 |

A complete gross pathological examination, organ weight recording and microscopic evaluation were performed on the six animals that were given 3 doses of Antibody 17 (Groups 2 to 4) two days after the third dose. There were no unscheduled deaths during the course of this study.

Antibody 17 administration was considered to be well tolerated at the injection sites. No adverse effects were observed throughout the study and no adverse findings were found on histopathology.

Example 16: Unilateral Ureteral Obstruction (UUO) Efficacy Model in Guinea Pigs

Unilateral ureteral obstruction (UUO) is a well-characterized disease model for renal fibrosis. The UUO model encompasses key pathophysiological features of chronic kidney disease; tubular necrosis and inflammatory cell infiltration within a relatively short period.

Method

Two unilateral ureteral obstruction (UUO) model efficacy studies were carried out in six-week old female Hartley guinea pigs. On Day 0, UUO surgery was performed. BMS-986020 was administered orally at a dose level of 30 mg/kg in a volume of 5 mL/kg twice daily at from Day −1 to 9. Isotype control and anti-LPAR1 antibody was intraperitoneally administered at a dose level of 6 mg/kg (low) or 20 mg/kg (high) in a volume of 10 mL/kg at Day −1, Day 0, Day 3 and Day 6. The viability, clinical signs, behaviour and individual body weight was monitored daily.

The animals were sacrificed at Day 10. The ligated left kidney and right kidney weight were measured at sacrifice.

Hydroxyproline is an amino acid, making up around 14% of collagen and acts as an important indicator of the severity of fibrosis. To quantify kidney hydroxyproline content, frozen posterior right section of left kidney samples were processed by an alkaline-acid hydrolysis method. AC buffer (2.2M acetic acid/0.48M citric acid) was added to the samples, followed by centrifugation to collect the supernatant. A standard curve of hydroxyproline was constructed with serial dilutions of trans-4-hydroxy-L-proline (Sigma-Aldrich, USA) starting at 16 µg/mL. The prepared samples and standards were mixed with chloramine T solution (Nacalai Tesque Inc., Japan) and incubated for 25 minutes at room temperature. The samples were then mixed with Ehrlich's solution and heated at 65° C. for 20 minutes to develop the colour. After samples were cooled on ice and centrifuged to remove precipitates, the optical density of each supernatant was measured at 560 nm. The concentrations of hydroxyproline were calculated from the hydroxyproline standard curve. Protein concentrations of kidney samples were determined using a BCA protein assay kit (Thermo Fisher Scientific, USA) and used to normalize the calculated hydroxyproline values. Kidney hydroxyproline contents were expressed as µg per mg protein.

The left kidney was fixed in Bouin's solution and embedded in paraffin. For PAS staining, sections were cut from paraffin blocks and stained with Schiff's reagent (FUJIFILM Wako pure chemical corporation, Japan) according to the manufacturer's instructions. To visualize collagen deposition, kidney sections were stained using picro-Sirius red solution (FUJIFILM Wako pure chemical corporation). For quantification of interstitial and medulla fibrosis area, bright field images in the corticomedullary region were captured using a digital camera (DFC295) at 200-fold magnification, and the positive areas in 5 fields/section were measured using ImageJ software (National Institute of Health, USA).

Results

Study 1 (FIG. 18A) used Antibody 13 as the anti-LPAR1 antibody at 20 mg/kg dosage. Each group included 8 animals. Histological picrosirius staining showed an increase in fibrotic area in the cortex after UUO surgery (Vehicle in FIG. 25A). Treatment with BMS-986020 reduced cortical fibrosis compared to vehicle. Treatment with anti-LPAR1 antibody produced a similar reduction in cortical fibrosis to the treatment with BMS-986020. No observable difference in hydroxyproline was found between groups.

Study 2 (FIG. 18B) used Antibody 17 as the anti-LPAR1 antibody. Each batch included 20 animals. Treatment with BMS-986020 showed a trend towards reduced hydroxyproline compared to vehicle. Treatment with 20 mg/kg (high) of anti-LPAR1 showed a significant reduction in hydroxyproline compared to isotype antibody. No observable difference in histological picrosirius staining was shown between groups.

A reduction in fibrotic markers; histological picrosirius staining or hydroxyproline measurements, were observed in groups from both studies which received anti-LPAR1 mAb.

Clauses

A set of clauses defining the invention and its preferred aspects is as follows:

1. A polypeptide which binds to LPAR1.
2. The polypeptide of clause 1 wherein the polypeptide comprises three heavy chain CDRs (HCDR1-3).
3. The polypeptide of either clause 1 or 2 wherein the polypeptide comprises a HCDR1 comprising a sequence having at least 40%, such as at least 60%, such as at least 80% identity with SEQ ID NO: 1 or SEQ ID NO: 7.
4. The polypeptide of clause 3 wherein the polypeptide comprises a HCDR1 consisting of a sequence having at least 40%, such as at least 60%, such as at least 80% identity with SEQ ID NO: 1 or SEQ ID NO: 7.
5. The polypeptide of clause 3 wherein the polypeptide comprises a HCDR1 comprising SEQ ID NO: 1.
6. The polypeptide of clause 5 wherein the polypeptide comprises a HCDR1 consisting of SEQ ID NO: 1.
7. The polypeptide of clause 3 wherein the polypeptide comprises a HCDR1 comprising SEQ ID NO: 7.
8. The polypeptide of clause 7 wherein the polypeptide comprises a HCDR1 consisting of SEQ ID NO: 7.
9. The polypeptide of any one of clauses 1 to 8 wherein the polypeptide comprises a HCDR2 comprising a sequence having at least 50%, such as at least 60%, such as at least 70%, such as at least 80%, such as at least 85%, such as at least 90% identity with any one of SEQ ID NOs: 2, 8 to 11 or 100.
10. The polypeptide of clause 9 wherein the polypeptide comprises a HCDR2 consisting of a sequence having at least 50%, such as at least 60%, such as at least 70%, such as at least 80%, such as at least 85%, such as at least 90% identity with any one of SEQ ID NOs: 2, 8 to 11 or 100.
11. The polypeptide of clause 9 wherein the polypeptide comprises a HCDR2 comprising any one of SEQ ID NOs: 2, 8 to 11 or 100.
12. The polypeptide of clause 10 wherein the polypeptide comprises a HCDR2 consisting of any one of SEQ ID NOs: 2, 8 to 11 or 100.
13. The polypeptide of clause 11 wherein the polypeptide comprises a HCDR2 comprising SEQ ID NO: 2 or SEQ ID NO: 100.
14. The polypeptide of clause 12 wherein the polypeptide comprises a HCDR2 consisting of SEQ ID NO: 2 or SEQ ID NO: 100.
15. The polypeptide of any one of clauses 1 to 14 wherein the polypeptide comprises a HCDR3 comprising a sequence having at least 60%, such as at least 70%, such as at least 80%, such as at least 85%, such as at least 90% identity with any one of SEQ ID NOs: 3, 12 to 15, or 101.
16. The polypeptide of clause 15 wherein the polypeptide comprises a HCDR3 consisting of a sequence having at least 60%, such as at least 70%, such as at least 80%, such as at least 85%, such as at least 90% identity with any one of SEQ ID NOs: 3, 12 to 15, or 101.
17. The polypeptide of clause 15 wherein the polypeptide comprises a HCDR3 comprising any one of SEQ ID NOs: 3, 12 to 15, or 101.
18. The polypeptide of clause 16 wherein the polypeptide comprises a HCDR3 consisting of any one of SEQ ID NOs: 3, 12 to 15, or 101.
19. The polypeptide of clause 17 wherein the polypeptide comprises a HCDR3 comprising SEQ ID NO: 3 or SEQ ID NO: 101.
20. The polypeptide of clause 18 wherein the polypeptide comprises a HCDR3 consisting of SEQ ID NO: 3 or SEQ ID NO: 101.
21. The polypeptide of any one of clauses 1 to 20 wherein the polypeptide comprises three light chain CDRs (LCDR1-3).
22. The polypeptide of clause 21 wherein the polypeptide comprises a LCDR1 comprising a sequence having at least 60%, such as at least 70%, such as at least 80%, such as at least 90% identity with any one of SEQ ID NOs: 4, 16 to 18 or 103.
23. The polypeptide of clause 22 wherein the polypeptide comprises a LCDR1 consisting of a sequence having at least 60%, such as at least 70%, such as at least 80%, such as at least 90% identity with any one of SEQ ID NOs: 4, 16 to 18 or 103.
24. The polypeptide of clause 22 wherein the polypeptide comprises a LCDR1 comprising any one of SEQ ID NOs: 4, 16 to 18 or 103.
25. The polypeptide of clause 23 wherein the polypeptide comprises a LCDR1 consisting of any one of SEQ ID NOs: 4, 16 to 18 or 103.
26. The polypeptide of clause 24 wherein the polypeptide comprises a LCDR1 comprising SEQ ID NO: 4 or SEQ ID NO: 103.
27. The polypeptide of clause 25 wherein the polypeptide comprises a LCDR1 consisting of SEQ ID NO: 4 or SEQ ID NO: 103.
28. The polypeptide of any one of clauses 1 to 27 wherein the polypeptide comprises a LCDR2 comprising a sequence having at least 50% identity, such as at least 60%, such as at least 70%, such as at least 80% identity with SEQ ID NO: 5, 19 or 98.
29. The polypeptide of clause 28 wherein the polypeptide comprises a LCDR2 consisting of a sequence having at least 50% identity, such as at least 60%, such as at least 70%, such as at least 80% identity with SEQ ID NO: 5, 19 or 98.
30. The polypeptide of clause 28 wherein the polypeptide comprises a LCDR2 comprising SEQ ID NO: 5, 19 or 98.
31. The polypeptide of clause 29 wherein the polypeptide comprises a LCDR2 consisting of SEQ ID NO: 5, 19 or 98.
32. The polypeptide of clause 30 wherein the polypeptide comprises a LCDR2 comprising SEQ ID NO: 98.
33. The polypeptide of clause 31 wherein the polypeptide comprises a LCDR2 consisting of SEQ ID NO: 98.
34. The polypeptide of any one of clauses 1 to 33 wherein the polypeptide comprises a LCDR3 comprising a sequence having at least 50%, such as at least 60%, such as at least 70%, such as at least 80% identity with any one of SEQ ID NOs: 6 or 20 to 22.
35. The polypeptide of clause 34 wherein the polypeptide comprises a LCDR3 consisting of a sequence having at least 50%, such as at least 60%, such as at least 70%, such as at least 80% identity with any one of SEQ ID NOs: 6 or 20 to 22.

36. The polypeptide of clause 34 wherein the polypeptide comprises a LCDR3 comprising any one of SEQ ID NOs: 6 or 20 to 22.

37. The polypeptide of clause 35 wherein the polypeptide comprises a LCDR3 consisting of any one of SEQ ID NOs: 6 or 20 to 22.

38. The polypeptide of clause 36 wherein the polypeptide comprises a LCDR3 comprising SEQ ID NO: 6.

39. The polypeptide of clause 37 wherein the polypeptide comprises a LCDR3 consisting of SEQ ID NO: 6.

40. The polypeptide of any one of clauses 1 to 39 wherein the residue of HCDR2 corresponding to residue number 5 of SEQ ID NO: 2 is arginine.

41. The polypeptide of any one of clauses 1 to 40 wherein the residue of HCDR3 corresponding to residue number 6 of SEQ ID NO: 3 is arginine.

42. The polypeptide of any one of clauses 1 to 41 wherein the residue of HCDR3 corresponding to residue number 7 of SEQ ID NO: 3 is tyrosine.

43. The polypeptide of any one of clauses 1 to 42 wherein the residue of LCDR2 corresponding to residue number 1 of SEQ ID NO: 5 is tyrosine.

44. The polypeptide of any one of clauses 1 to 43 wherein the residue of LCDR3 corresponding to residue number 3 of SEQ ID NO: 6 is histidine.

45. The polypeptide of clause 1 wherein the polypeptide comprises (a) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 5 and a LCDR3 comprising SEQ ID NO: 6;

(b) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 20;

(c) a HCDR1 comprising SEQ ID NO: 7, a HCDR2 comprising SEQ ID NO: 9, a HCDR3 comprising SEQ ID NO: 13, a LCDR1 comprising SEQ ID NO: 17, a LCDR2 comprising SEQ ID NO: 19 and a LCDR3 comprising SEQ ID NO: 21;

(d) a HCDR1 comprising SEQ ID NO: 1, a HCDR2 comprising SEQ ID NO: 10, a HCDR3 comprising SEQ ID NO: 14, a LCDR1 comprising SEQ ID NO: 18, a LCDR2 comprising SEQ ID NO: 19 and a LCDR3 comprising SEQ ID NO: 6;

(e) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 22;

(f) a HCDR1 comprising SEQ ID NO: 1, a HCDR2 comprising SEQ ID NO: 8, a HCDR3 comprising SEQ ID NO: 12, a LCDR1 comprising SEQ ID NO: 16, a LCDR2 comprising SEQ ID NO: 19 and a LCDR3 comprising SEQ ID NO: 6;

(g) a HCDR1 comprising SEQ ID NO: 1, a HCDR2 comprising SEQ ID NO: 11, a HCDR3 comprising SEQ ID NO: 12, a LCDR1 comprising SEQ ID NO: 4, a LCDR2 comprising SEQ ID NO: 19 and a LCDR3 comprising SEQ ID NO: 20;

(h) a HCDR1 comprising SEQ ID NO: 1, a HCDR2 comprising SEQ ID NO: 11, a HCDR3 comprising SEQ ID NO: 12, a LCDR1 comprising SEQ ID NO: 4, a LCDR2 comprising SEQ ID NO: 19 and a LCDR3 comprising SEQ ID NO: 6;

(i) a HCDR1 comprising SEQ ID NO: 1, a HCDR2 comprising SEQ ID NO: 2, a HCDR3 comprising SEQ ID NO: 12, a LCDR1 comprising SEQ ID NO: 4, a LCDR2 comprising SEQ ID NO: 19 and a LCDR3 comprising SEQ ID NO: 6;

(j) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 19 and a LCDR3 comprising SEQ ID NO: 6;

(k) a HCDR1 comprising SEQ ID NO: 1, a HCDR2 comprising SEQ ID NO: 2, a HCDR3 comprising SEQ ID NO: 15, a LCDR1 comprising SEQ ID NO: 4, a LCDR2 comprising SEQ ID NO: 19 and a LCDR3 comprising SEQ ID NO: 6;

(l) a HCDR1 comprising SEQ ID NO: 1, a HCDR2 comprising SEQ ID NO: 2, a HCDR3 comprising SEQ ID NO: 15, a LCDR1 comprising SEQ ID NO: 4, a LCDR2 comprising SEQ ID NO: 5 and a LCDR3 comprising SEQ ID NO: 6;

(m) a HCDR1 comprising SEQ ID NO: 1, a HCDR2 comprising SEQ ID NO: 2, a HCDR3 comprising SEQ ID NO: 3, a LCDR1 comprising SEQ ID NO: 4, a LCDR2 comprising SEQ ID NO: 98 and a LCDR3 comprising SEQ ID NO: 6;

(n) a HCDR1 comprising SEQ ID NO: 1, a HCDR2 comprising SEQ ID NO: 100, a HCDR3 comprising SEQ ID NO: 101, a LCDR1 comprising SEQ ID NO: 4, a LCDR2 comprising SEQ ID NO: 98 and a LCDR3 comprising SEQ ID NO: 6 or (o) a HCDR1 comprising SEQ ID NO: 1, a HCDR2 comprising SEQ ID NO: 100, a HCDR3 comprising SEQ ID NO: 101, a LCDR1 comprising SEQ ID NO: 103, a LCDR2 comprising SEQ ID NO: 98 and a LCDR3 comprising SEQ ID NO: 6.

46. The polypeptide of clause 45 wherein the polypeptide comprises (a) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 5 and a LCDR3 consisting of SEQ ID NO: 6;

(b) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 20;

(c) a HCDR1 consisting of SEQ ID NO: 7, a HCDR2 consisting of SEQ ID NO: 9, a HCDR3 consisting of SEQ ID NO: 13, a LCDR1 consisting of SEQ ID NO: 17, a LCDR2 consisting of SEQ ID NO: 19 and a LCDR3 consisting of SEQ ID NO: 21;

(d) a HCDR1 consisting of SEQ ID NO: 1, a HCDR2 consisting of SEQ ID NO: 10, a HCDR3 consisting of SEQ ID NO: 14, a LCDR1 consisting of SEQ ID NO: 18, a LCDR2 consisting of SEQ ID NO: 19 and a LCDR3 consisting of SEQ ID NO: 6;

(e) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 22;

(f) a HCDR1 consisting of SEQ ID NO: 1, a HCDR2 consisting of SEQ ID NO: 8, a HCDR3 consisting of SEQ ID NO: 12, a LCDR1 consisting of SEQ ID NO: 16, a LCDR2 consisting of SEQ ID NO: 19 and a LCDR3 consisting of SEQ ID NO: 6;

(g) a HCDR1 consisting of SEQ ID NO: 1, a HCDR2 consisting of SEQ ID NO: 11, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 20;

(h) a HCDR1 consisting of SEQ ID NO: 1, a HCDR2 consisting of SEQ ID NO: 11, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 6;

(i) a HCDR1 consisting of SEQ ID NO: 1, a HCDR2 consisting of SEQ ID NO: 2, a HCDR3 consisting of SEQ ID NO: 12, a LCDR1 consisting of SEQ ID NO: 4, a LCDR2 consisting of SEQ ID NO: 19 and a LCDR3 consisting of SEQ ID NO: 6;

(j) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 19 and a LCDR3 consisting of SEQ ID NO: 6;

(k) a HCDR1 consisting of SEQ ID NO: 1, a HCDR2 consisting of SEQ ID NO: 2, a HCDR3 consisting of SEQ ID NO: 15, a LCDR1 consisting of SEQ ID NO: 4, a LCDR2 consisting of SEQ ID NO: 19 and a LCDR3 consisting of SEQ ID NO: 6;

(l) a HCDR1 consisting of SEQ ID NO: 1, a HCDR2 consisting of SEQ ID NO: 2, a HCDR3 consisting of SEQ ID NO: 15, a LCDR1 consisting of SEQ ID NO: 4, a LCDR2 consisting of SEQ ID NO: 5 and a LCDR3 consisting of SEQ ID NO: 6;

(m) a HCDR1 consisting of SEQ ID NO: 1, a HCDR2 consisting of SEQ ID NO: 2, a HCDR3 consisting of SEQ ID NO: 3, a LCDR1 consisting of SEQ ID NO: 4, a LCDR2 consisting of SEQ ID NO: 98 and a LCDR3 consisting of SEQ ID NO: 6;

(n) a HCDR1 consisting of SEQ ID NO: 1, a HCDR2 consisting of SEQ ID NO: 100, a HCDR3 consisting of SEQ ID NO: 101, a LCDR1 consisting of SEQ ID NO: 4, a LCDR2 consisting of SEQ ID NO: 98 and a LCDR3 consisting of SEQ ID NO: 6 or (o) a HCDR1 consisting of SEQ ID NO: 1, a HCDR2 consisting of SEQ ID NO: 100, a HCDR3 consisting of SEQ ID NO: 101, a LCDR1 consisting of SEQ ID NO: 103, a LCDR2 consisting of SEQ ID NO: 98 and a LCDR3 consisting of SEQ ID NO: 6.

47. The polypeptide of any one of clauses 1 to 46 wherein the polypeptide comprises three heavy chain CDRs (HCDR1-HCDR3) and three light chain CDRs (LCDR1-LCDR3) (wherein the CDRs are defined by a non-Kabat numbering system in this clause) wherein HCDR1 comprises (e.g. consists of) $X_1X_2X_3X_4X_5X_6$ (SEQ ID NO: 72), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 76), HCDR3 comprises (e.g. consists of) $DX_{20}X_{21}X_{22}X_{23}X_{24}X_{25}X_{26}X_{27}X_{28}X_{29}DY$ (SEQ ID NO: 80), LCDR1 comprises (e.g. consists of) $X_{30}X_{31}X_{32}X_{33}X_{34}X_{35}X_{36}X_{37}X_{38}X_{39}X_{40}$ (SEQ ID NO: 84), LCDR2 comprises (e.g. consists of) $X_{41}AX_{42}X_{43}X_{44}X_{45}X_{46}$ (SEQ ID NO: 88) and LCDR3 comprises (e.g. consists of) $X_{47}X_{48}X_{49}X_{50}X_{51}X_{52}PLX_{53}$ (SEQ ID NO: 92), wherein:

the amino acid of $X_1$ is selected from the group consisting of S, Y, T, G, R, E, K, D and N;

the amino acid of $X_2$ is selected from the group consisting of K, R, L, T, G, V, A, S, F, W, Q, M, Y, I, E, H, N, D and P;

the amino acid of $X_3$ is selected from the group consisting of R, K, H, T, S, F, G, V, A, L, N, Q, E, M, P, W and I;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V, A, K, M, H and Y;

the amino acid of $X_7$ is selected from the group consisting of E;

the amino acid of $X_8$ is selected from the group consisting of L, Q and D;

the amino acid of $X_9$ is selected from the group consisting of P, A, G, F, S, T and W;

the amino acid of $X_{10}$ is selected from the group consisting of R;

the amino acid of $X_{11}$ is selected from the group consisting of S, T and D;

the amino acid of $X_{12}$ is selected from the group consisting of G, R, S, Y, A, T, D, E and W;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M, P, W, H, L, I, S, T and A;

the amino acid of $X_{17}$ is selected from the group consisting of Q, A, I, S, P, T, N, V, G, H, L, M, W, K, R, F, D, Y and E;

the amino acid of $X_{18}$ is selected from the group consisting of G, D, E, H, L, V, Y, A, F, I, K, Q, W, R, M, P, S and N;

the amino acid of $X_{19}$ is selected from the group consisting of T, K, Q, E, R and M;

the amino acid of $X_{29}$ is selected from the group consisting of R, F, K, I, A, L, V, W, Y, M, P, Q, G and S;

the amino acid of $X_{21}$ is not present or is selected from the group consisting of K and R;

the amino acid of $X_{22}$ is selected from the group consisting of K, R, A, H, S, Q, T, P, M, W, Y, G, L, F, V, E and N;

the amino acid of $X_{23}$ is not present or is selected from the group consisting of K and R;

the amino acid of $X_{24}$ is selected from the group consisting of R, Y, A, H, P, L, K, G, Q, N, I, F, W, S, T, M, E, V and D;

the amino acid of $X_{25}$ is selected from the group consisting of A, Q, T, S, G, V, R, I, H, K, P, L, M and F;

the amino acid of $X_{26}$ is selected from the group consisting of R and S;

the amino acid of $X_{27}$ is selected from the group consisting of Y, H, Q and A;

the amino acid of $X_{28}$ is selected from the group consisting of A, T, S, D and E;

the amino acid of $X_{29}$ is selected from the group consisting of M and L;

the amino acid of $X_{30}$ is selected from the group consisting of Q, K, R, S and T;

the amino acid of $X_{31}$ is selected from the group consisting of A, S and T;

the amino acid of $X_{32}$ is selected from the group consisting of S, T and D;

the amino acid of $X_{33}$ is selected from the group consisting of Q, G, R, K, L, M, P, Y, S, A, N, H, W, D, E, F, T and I;

the amino acid of $X_{34}$ is selected from the group consisting of S, G, H, N, T, Y and D;

the amino acid of $X_{35}$ is selected from the group consisting of V, A and I;

the amino acid of $X_{36}$ is selected from the group consisting of R, K, S, G and A;

the amino acid of $X_{37}$ is selected from the group consisting of Y, F, L, Q, S, H, T, G, I, M, V, W, K, N, R, D and P;

the amino acid of $X_{38}$ is selected from the group consisting of N, A, G, H, Q, S, Y, F and W;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, T, A, D, K, L, N, Q, M, W, E, F and S;

the amino acid of $X_{42}$ is selected from the group consisting of S, K, M, Q, R, V, Y, G, E, D, T, A, F, I, N, W, H and L;

the amino acid of $X_{43}$ is selected from the group consisting of N, K, R, Q, T, Y, A, S, D and E;

the amino acid of $X_{44}$ is selected from the group consisting of R, L, K and A;

the amino acid of $X_{45}$ is selected from the group consisting of Y, I, K, M, Q, R, V, A, N, S, W, H, L, T, P, D, F, G and E;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q, S and L;

the amino acid of $X_{48}$ is selected from the group consisting of H, N, S, T, A, Q and V;

the amino acid of $X_{49}$ is selected from the group consisting of H, A, D and F;

the amino acid of $X_{50}$ is selected from the group consisting of Y and L;

the amino acid of $X_{51}$ is selected from the group consisting of S, K, V, D, N, R, H, T, A, G, Q, I, M, F, W, Y and L;

the amino acid of $X_{52}$ is selected from the group consisting of S, A, T, G, V, W and Y; and the amino acid of $X_{53}$ is selected from the group consisting of T and Y.

48. The polypeptide of clause 47 wherein HCDR1 comprises (e.g. consists of) $X_1X_2X_3X_4X_5X_6$ (SEQ ID NO: 73), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 77), HCDR3 comprises (e.g. consists of) $DX_{20}X_{21}X_{22}X_{23}X_{24}X_{25}X_{26}X_{27}X_{28}X_{29}DY$ (SEQ ID NO: 81), LCDR1 comprises (e.g. consists of) $X_{30}X_{31}X_{32}X_{33}X_{34}X_{35}X_{36}X_{37}X_{38}X_{39}X_{40}$ (SEQ ID NO: 85), LCDR2 comprises (e.g. consists of) $X_{41}AX_{42}X_{43}X_{44}X_{45}X_{46}$ (SEQ ID NO: 89) and LCDR3 comprises (e.g. consists of) $X_{47}X_{48}X_{49}X_{50}X_{51}X_{52}PLX_{53}$ (SEQ ID NO: 93)

(wherein the CDRs are defined by a non-Kabat numbering system in this clause), wherein:

the amino acid of $X_1$ is selected from the group consisting of S, Y, T, G, R, E and K;

the amino acid of $X_2$ is selected from the group consisting of K, R, L, T, G, V, A, S, F, W, Q, M, Y, I, E, H and N;

the amino acid of $X_3$ is selected from the group consisting of R, K, H, T, S, F, G, V, A, L, N, Q, E, M, P and W;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V, A, K and M;

the amino acid of $X_7$ is selected from the group consisting of E;

the amino acid of $X_8$ is selected from the group consisting of L and Q;

the amino acid of $X_9$ is selected from the group consisting of P, A, G, F, S and T;

the amino acid of $X_{10}$ is selected from the group consisting of R;

the amino acid of $X_{11}$ is selected from the group consisting of S, T and D;

the amino acid of $X_{12}$ is selected from the group consisting of G, R, S, Y, A, T, D, E and W;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M, P, W, H and L;

the amino acid of $X_{17}$ is selected from the group consisting of Q, A, I, S, P, T, N, V, G, H, L, M, W, K, R, F, D, Y and E;

the amino acid of $X_{18}$ is selected from the group consisting of G, D, E, H, L, V, Y, A, F, I, K, Q, W, R, M, P and S;

the amino acid of $X_{19}$ is selected from the group consisting of T, K, Q, E, R and M;

the amino acid of $X_{20}$ is selected from the group consisting of R, F, K, I, A, L, V, W, Y and M, the amino acid of $X_{21}$ is not present or is selected from the group consisting of K and R;

the amino acid of $X_{22}$ is selected from the group consisting of K, R, A, H, S, Q, T, P, M, W, Y, G, L, F and V;

the amino acid of $X_{23}$ is not present or is selected from the group consisting of K and R;

the amino acid of $X_{24}$ is selected from the group consisting of R, Y, A, H, P, L, K, G, Q, N, I, F, W, S, T, M, E, V and D;

the amino acid of $X_{25}$ is selected from the group consisting of A, Q, T, S, G, V, R and I;

the amino acid of $X_{26}$ is selected from the group consisting of R and S;

the amino acid of $X_{27}$ is selected from the group consisting of Y;

the amino acid of $X_{28}$ is selected from the group consisting of A, T, S and D;

the amino acid of $X_{29}$ is selected from the group consisting of M and L;

the amino acid of $X_{30}$ is selected from the group consisting of Q, K, R, S and T;

the amino acid of $X_{31}$ is selected from the group consisting of A, S and T;

the amino acid of $X_{32}$ is selected from the group consisting of S, T and D;

the amino acid of $X_{33}$ is selected from the group consisting of Q, G, R, K, L, M, P, Y, S, A, N, H, W, D and E;

the amino acid of $X_{34}$ is selected from the group consisting of S, G, H, N, T and Y;

the amino acid of $X_{35}$ is selected from the group consisting of V, A and I;

the amino acid of $X_{36}$ is selected from the group consisting of R, K, S and G;

the amino acid of $X_{37}$ is selected from the group consisting of Y, F, L, Q, S, H, T, G, I, M, V, W, K, N and R;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, T, A, D, K, L, N and Q;

the amino acid of $X_{42}$ is selected from the group consisting of S, K, M, Q, R, V, Y, G, E, D, T, A, F, I, N, W and H;

the amino acid of $X_{43}$ is selected from the group consisting of N, K, R, Q, T, Y, A, S, D and E;

the amino acid of $X_{44}$ is selected from the group consisting of R, L and K;

the amino acid of $X_{45}$ is selected from the group consisting of Y, I, K, M, Q, R, V, A, N, S, W, H, L, T, P, D, F and G;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q, S and L;

the amino acid of $X_{48}$ is selected from the group consisting of H, N, S, T, A and Q;

the amino acid of $X_{49}$ is selected from the group consisting of H;

the amino acid of $X_{50}$ is selected from the group consisting of Y and L;

the amino acid of $X_{51}$ is selected from the group consisting of S, K, V, D, N, R, H, T, A, G, Q, I, M, F, W and Y;

the amino acid of $X_{52}$ is selected from the group consisting of S, A, T and G; and the amino acid of $X_{53}$ is selected from the group consisting of T and Y.

49. The polypeptide of clause 48 wherein HCDR1 comprises (e.g. consists of) $X_1X_2X_3X_4X_5X_6$ (SEQ ID NO: 74), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 78), HCDR3 comprises (e.g. consists of) $DX_{20}X_{21}X_{22}X_{23}X_{24}X_{25}X_{26}X_{27}X_{28}X_{29}DY$ (SEQ ID NO: 82), LCDR1 comprises (e.g. consists of) $X_{30}X_{31}X_{32}X_{33}X_{34}X_{35}X_{36}X_{37}X_{38}X_{39}X_{49}$ (SEQ ID NO: 86), LCDR2 comprises (e.g. consists of) $X_{41}AX_{42}X_{43}X_{44}X_{45}X_{46}$ (SEQ ID NO: 90) and LCDR3 comprises (e.g. consists of) $X_{47}X_{48}X_{49}X_{50}X_{51}X_{52}PLX_{53}$ (SEQ ID NO: 94)

(wherein the CDRs are defined by a non-Kabat numbering system in this clause), wherein:

the amino acid of $X_1$ is selected from the group consisting of S, Y, T, G and R;

the amino acid of $X_2$ is selected from the group consisting of K, R, L, T, G, V, A, S, F, W, Q, M, Y, I and E;

the amino acid of $X_3$ is selected from the group consisting of R, K, H, T, S, F, G, V, A, L, N and Q;

the amino acid of $X_4$ is selected from the group consisting of A and G;

the amino acid of $X_5$ is selected from the group consisting of M and I;

the amino acid of $X_6$ is selected from the group consisting of S, E, G, D, L, T, N, Q, I, V and A;

the amino acid of $X_7$ is selected from the group consisting of E;

the amino acid of $X_8$ is selected from the group consisting of L and Q;

the amino acid of $X_9$ is selected from the group consisting of P, A, G, F and S;

the amino acid of $X_{10}$ is selected from the group consisting of R;

the amino acid of $X_{11}$ is selected from the group consisting of S and T;

the amino acid of $X_{12}$ is selected from the group consisting of G, R, S, Y, A and T;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D, E, Y, G, M and P;

the amino acid of $X_{17}$ is selected from the group consisting of Q, A, I, S, P, T, N, V, G, H, L, M, W, K, R and F;

the amino acid of $X_{18}$ is selected from the group consisting of G, D, E, H, L, V, Y, A, F, I, K, Q, W, R, M, P and S;

the amino acid of $X_{19}$ is selected from the group consisting of T, K, Q, E, R and M;

the amino acid of $X_{20}$ is selected from the group consisting of R, F, K, I, A, L, V, W and Y;

the amino acid of $X_{21}$ is not present or is selected from the group consisting of K and R the amino acid of $X_{22}$ is selected from the group consisting of K, R, A, H, S, Q, T, P, M, W, G and Y;

the amino acid of $X_{23}$ is not present or is selected from the group consisting of K and R the amino acid of $X_{24}$ is selected from the group consisting of R, Y, A, H, P, L, K, G, Q, N, I, F, W, S, T, M, E and V;

the amino acid of $X_{25}$ is selected from the group consisting of A, Q, T, S, G and V;

the amino acid of $X_{26}$ is selected from the group consisting of R;

the amino acid of $X_{27}$ is selected from the group consisting of Y;

the amino acid of $X_{28}$ is selected from the group consisting of A, T, S and D;

the amino acid of $X_{29}$ is selected from the group consisting of M;

the amino acid of $X_{30}$ is selected from the group consisting of Q, K, R, S and T;

the amino acid of $X_{31}$ is selected from the group consisting of A, S and T;

| the amino acid of $X_{32}$ is selected from the group consisting of S, T and D;

the amino acid of $X_{33}$ is selected from the group consisting of Q, G, R, K, L, M, P, Y, S, A, N, H and W;

the amino acid of $X_{34}$ is selected from the group consisting of S, G, H, N, T and Y;

the amino acid of $X_{35}$ is selected from the group consisting of V, A and I;

the amino acid of $X_{36}$ is selected from the group consisting of R, K and S;

the amino acid of $X_{37}$ is selected from the group consisting of Y, F, L, Q, S, H, T, G, I, M, V, W, K, N and R;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A, G and D;

the amino acid of $X_{41}$ is selected from the group consisting of Y, H, R, and T;

the amino acid of $X_{42}$ is selected from the group consisting of S, K, M, Q, R, V, Y, G, E, D, T, A, F, I, N and W;

the amino acid of $X_{43}$ is selected from the group consisting of N, K, R, Q, T, Y, A and S;

the amino acid of $X_{44}$ is selected from the group consisting of R, L and K;

the amino acid of $X_{45}$ is selected from the group consisting of Y, I, K, M, Q, R, V, A, N, S, W, H, L, T, P, D and F;

the amino acid of $X_{46}$ is selected from the group consisting of T, A, D, E, Q, R, S, H, K, P, L, F, G, I, M, V, W, Y and N;

the amino acid of $X_{47}$ is selected from the group consisting of Q and S;

the amino acid of $X_{48}$ is selected from the group consisting of H, N, S, T, A and Q;

the amino acid of $X_{49}$ is selected from the group consisting of H;

the amino acid of $X_{50}$ is selected from the group consisting of Y;

the amino acid of $X_{51}$ is selected from the group consisting of S, K, V, D, N, R, H, T, A and G;

the amino acid of $X_{52}$ is selected from the group consisting of S and A; and the amino acid of $X_{53}$ is selected from the group consisting of T and Y.

50. The polypeptide of clause 49 wherein HCDR1 comprises (e.g. consists of) $X_1X_2X_3X_4X_5X_6$ (SEQ ID NO: 75), HCDR2 comprises (e.g. consists of) $X_7IX_8X_9X_{10}X_{11}X_{12}X_{13}X_{14}X_{15}YX_{16}X_{17}X_{18}FX_{19}G$ (SEQ ID NO: 79), HCDR3 comprises (e.g. consists of) $DX_{20}X_{21}X_{22}X_{23}X_{24}X_{25}X_{26}X_{27}X_{28}X_{29}DY$ (SEQ ID NO: 83), LCDR1 comprises (e.g. consists of) $X_{30}X_{31}X_{32}X_{33}X_{34}X_{35}X_{36}X_{37}X_{38}X_{39}X_{40}$ (SEQ ID NO: 87), LCDR2 comprises (e.g. consists of) $X_{41}AX_{42}X_{43}X_{44}X_{45}X_{46}$ (SEQ ID NO: 91) and LCDR3 comprises (e.g. consists of) $X_{47}X_{48}X_{49}X_{50}X_{51}X_{52}PLX_{53}$ (SEQ ID NO: 95) (wherein the CDRs are defined by a non-Kabat numbering system in this clause), wherein:

the amino acid of $X_1$ is selected from the group consisting of S, Y, T and G;

the amino acid of $X_2$ is selected from the group consisting of K, R, L, T, G, V, A, S, F, W, Q, M and Y;

the amino acid of $X_3$ is selected from the group consisting of R, K, H, T, S, F, G and V;

the amino acid of $X_4$ is selected from the group consisting of A and G;

the amino acid of $X_5$ is selected from the group consisting of M and I;

the amino acid of $X_6$ is selected from the group consisting of S, E, G, D, L and T;

the amino acid of $X_7$ is selected from the group consisting of E;

the amino acid of $X_8$ is selected from the group consisting of L and Q;

the amino acid of $X_9$ is selected from the group consisting of P, A and G;

the amino acid of $X_{10}$ is selected from the group consisting of R;

the amino acid of $X_{11}$ is selected from the group consisting of S and T;

the amino acid of $X_{12}$ is selected from the group consisting of G and R;

the amino acid of $X_{13}$ is selected from the group consisting of Y;

the amino acid of $X_{14}$ is selected from the group consisting of T;

the amino acid of $X_{15}$ is selected from the group consisting of N, H and S;

the amino acid of $X_{16}$ is selected from the group consisting of R, N, F, K, Q, V, D and E;

the amino acid of $X_{17}$ is selected from the group consisting of Q, A, I, S, P, T, N and V;

the amino acid of $X_{18}$ is selected from the group consisting of G, D, E, H, L, V, Y, A, F, I, K, Q, W and R;

the amino acid of $X_{19}$ is selected from the group consisting of T and K;

the amino acid of $X_{20}$ is selected from the group consisting of R, F, K and I;

the amino acid of $X_{21}$ is not present or is selected from the group consisting of K and R;

the amino acid of $X_{22}$ is selected from the group consisting of K, G and R;

the amino acid of $X_{23}$ is not present or is selected from the group consisting of K and R;

the amino acid of $X_{24}$ is selected from the group consisting of R, Y, A, H, P, L, K, G, Q, N, I, F and W;

the amino acid of $X_{25}$ is selected from the group consisting of A, Q, T, S and G;

the amino acid of $X_{26}$ is selected from the group consisting of R;

the amino acid of $X_{27}$ is selected from the group consisting of Y;

the amino acid of $X_{28}$ is selected from the group consisting of A, T and S;

the amino acid of $X_{29}$ is selected from the group consisting of M;

the amino acid of $X_{30}$ is selected from the group consisting of Q, K, R, S and T;

the amino acid of $X_{31}$ is selected from the group consisting of A and S;

the amino acid of $X_{32}$ is selected from the group consisting of S and T;

the amino acid of $X_{33}$ is selected from the group consisting of Q, G, R, K, L, M, P, Y and S;

the amino acid of $X_{34}$ is selected from the group consisting of S, G, H and N;

the amino acid of $X_{35}$ is selected from the group consisting of V, A and I;

the amino acid of $X_{36}$ is selected from the group consisting of R;

the amino acid of $X_{37}$ is selected from the group consisting of Y, F, L, Q, S, H, T, G, I, M, V and W;

the amino acid of $X_{38}$ is selected from the group consisting of N, A, G, H, Q and S;

the amino acid of $X_{39}$ is selected from the group consisting of V, I, M and L;

the amino acid of $X_{40}$ is selected from the group consisting of A and G;

the amino acid of $X_{41}$ is selected from the group consisting of Y and H the amino acid of $X_{42}$ is selected from the group consisting of S, K, M, Q, R, V, Y, G and E;

the amino acid of $X_{43}$ is selected from the group consisting of N, K and R;

the amino acid of $X_{44}$ is selected from the group consisting of R, L and K;

the amino acid of $X_{45}$ is selected from the group consisting of Y, I, K, M, Q, R, V, A, N, S, W and H;

the amino acid of $X_{46}$ is selected from the group consisting of T, A, D, E, Q, R, S, H, K, P, L, F, G, I, M and V;

the amino acid of $X_{47}$ is selected from the group consisting of Q;

the amino acid of $X_{48}$ is selected from the group consisting of H, N, S and T;

the amino acid of $X_{49}$ is selected from the group consisting of H;

the amino acid of $X_{50}$ is selected from the group consisting of Y;

the amino acid of $X_{51}$ is selected from the group consisting of S, K and V;

the amino acid of $X_{52}$ is selected from the group consisting of S and A; and the amino acid of $X_{53}$ is selected from the group consisting of T 51. The polypeptide of any one of clauses 47 to 50 wherein $X_{21}$ and/or $X_{23}$ are not present.

52. The polypeptide of any one of clauses 47 to 51 wherein at least one of $X_{20}$, $X_{21}$, $X_{22}$, $X_{23}$, $X_{24}$ and $X_{25}$ is Lysine or Arginine, such as at least one of $X_{20}$, $X_{21}$ and $X_{22}$.

53. The polypeptide of clause 52 wherein no more than one of $X_{20}$, $X_{21}$ and $X_{22}$ are Lysine or Arginine, such as no more than one of $X_{20}$, $X_{21}$, $X_{22}$, $X_{23}$, $X_{24}$ and $X_{25}$.

54. The polypeptide of any one of clauses 1 to 53 wherein the polypeptide comprises four heavy chain framework regions (HFR1-HFR4).

55. The polypeptide of clause 54 wherein the polypeptide comprises a HFR1 comprising or consisting of a sequence having at least 50%, such as at least 60%, such as at least 70%, such as at least 80%, such as at least 90% identity with SEQ ID NO: 40, a HFR2 comprising or consisting of a sequence having at least 50%, such as at least 60%, such as at least 70%, such as at least 80%, such as at least 90% identity with SEQ ID NO: 41, a HFR3 comprising or consisting of a sequence having at least 50%, such as at least 60%, such as at least 70%, such as at least 80%, such as at least 90% identity with SEQ ID NO: 42 and/or a HFR4 comprising or consisting of a sequence having at least 50%, such as at least 60%, such as at least 70%, such as at least 80%, such as at least 90% identity with SEQ ID NO: 43.

56. The polypeptide of clause 55 wherein the residue corresponding to residue 13 of SEQ ID NO: 41 is selected from I and M, the residue corresponding to residue 3 of SEQ ID NO: 42 is selected from V and S, the residue corresponding to residue 4 of SEQ ID NO: 42 is selected from L and F, the residue corresponding to residue 10 of SEQ ID NO: 42 is selected from S, A and V, the residue corresponding to residue 29 of SEQ ID NO: 42 is selected from F and Y, and/or the residue corresponding to residue 2 of SEQ ID NO: 43 is selected from G and S.

57. The polypeptide of either clause 55 or 56 wherein the polypeptide comprises a HFR1 comprising SEQ ID NO: 40, a HFR2 comprising SEQ ID NO: 41, a HFR3 comprising SEQ ID NO: 42 and/or a HFR4 comprising SEQ ID NO: 43.

58. The polypeptide of clause 57 wherein the polypeptide comprises a HFR1 consisting of SEQ ID NO: 40, a HFR2 consisting of SEQ ID NO: 41, a HFR3 consisting of SEQ ID NO: 42 and/or a HFR4 consisting of SEQ ID NO: 43.

59. The polypeptide of any one of clauses 1 to 58 wherein the polypeptide comprises four light chain framework regions (LFR1-LFR4).

60. The polypeptide of clause 59 wherein the polypeptide comprises a LFR1 comprising or consisting of a sequence having at least 50%, such as at least 60%, such as at least 70%, such as at least 80%, such as at least 90% identity with SEQ ID NO: 44, a LFR2 comprising or consisting of a sequence having at least 50%, such as at least 60%, such as at least 70%, such as at least 80%, such as at least 90% identity with SEQ ID NO: 45, a LFR3 comprising or consisting of a sequence having at least 50%, such as at least 60%, such as at least 70%, such as at least 80%, such as at least 90% identity with SEQ ID NO: 46 and/or a LFR4 comprising or consisting of a sequence having at least 50%, such as at least 60%, such as at least 70%, such as at least 80%, such as at least 90% identity with SEQ ID NO: 47.

61. The polypeptide of clause 60 wherein the residue corresponding to residue 1 of SEQ ID NO: 44 is selected from S, D, Q, E, N and A and/or the residue corresponding to residue 31 of SEQ ID NO: 46 is selected from F and Y.

62. The polypeptide of either clause 60 or 61 wherein the polypeptide comprises a LFR1 comprising SEQ ID NO: 44, a LFR2 comprising SEQ ID NO: 45, a LFR3 comprising SEQ ID NO: 46 and/or a LFR4 comprising SEQ ID NO: 47.

63. The polypeptide of clause 62 wherein the polypeptide comprises a LFR1 consisting of SEQ ID NO: 44, a LFR2 consisting of SEQ ID NO: 45, a LFR3 consisting of SEQ ID NO: 46 and/or a LFR4 consisting of SEQ ID NO: 47.

64. The polypeptide of any one of clauses 1 to 63 wherein the polypeptide comprises a VH region.

65. The polypeptide of clause 64 wherein the VH region comprises an amino acid sequence having at least 60%, such as at least 70%, such as at least 80%, such as at least 90%, such as at least 95%, such as at least 98%, such as at least 99% sequence identity with any one of SEQ ID NOs: 23, 25, 27, 29, 33, 35, 36, 37, 96 or 102.

66. The polypeptide of clause 65 wherein the VH region consists of an amino acid sequence having at least 60%, such as at least 70%, such as at least 80%, such as at least 90%, such as at least 95%, such as at least 98%, such as at least 99% sequence identity with any one of SEQ ID NOs: 23, 25, 27, 29, 33, 35, 36, 37, 96 or 102.

67. The polypeptide of clause 65 wherein the VH region comprises an amino acid sequence of SEQ ID NOs: 23, 25, 27, 29, 33, 35, 36, 37, 96 or 102.

68. The polypeptide of clause 67 wherein the VH region comprises an amino acid sequence of SEQ ID NO: 36.

69. The polypeptide of clause 67 wherein the VH region comprises an amino acid sequence of SEQ ID NO: 37.

70. The polypeptide of clause 67 wherein the VH region comprises an amino acid sequence of SEQ ID NO: 102.

71. The polypeptide of clause 66 wherein the VH region consists of an amino acid sequence of SEQ ID NOs: 23, 25, 27, 29, 33, 35, 36, 37, 96 or 102.

72. The polypeptide of clause 71 wherein the VH region consists of an amino acid sequence of SEQ ID NO: 36.

73. The polypeptide of clause 71 wherein the VH region consists of an amino acid sequence of SEQ ID NO: 37.

74. The polypeptide of clause 71 wherein the VH region consists of an amino acid sequence of SEQ ID NO: 102.

75. The polypeptide of any one of clauses 1 to 74 wherein the polypeptide comprises a VL region.

76. The polypeptide of clause 75 wherein the VL region comprises an amino acid sequence having at least 60%, such as at least 70%, such as at least 80%, such as at least 90%, such as at least 95%, such as at least 98%, such as at least 99% sequence identity with any one of SEQ ID NOs: 24, 26, 28, 30, 31, 32, 34, 38, 39, 97, 99 or 104.

77. The polypeptide of any clause 76 wherein the VL region consists of an amino acid sequence having at least 60%, such as at least 70%, such as at least 80%, such as at least 90%, such as at least 95%, such as at least 98%, such as at least 99% sequence identity with any one of SEQ ID NOs: 24, 26, 28, 30, 31, 32, 34, 38, 39, 97, 99 or 104.

78. The polypeptide of clause 76 wherein the VL region comprises an amino acid sequence of SEQ ID NOs: 24, 26, 28, 30, 31, 32, 34, 38, 39, 97, 99 or 104.

79. The polypeptide of clause 78 wherein the VL region comprises an amino acid sequence of SEQ ID NO: 38.

80. The polypeptide of clause 78 wherein the VL region comprises an amino acid sequence of SEQ ID NO: 99.

81. The polypeptide of clause 78 wherein the VL region comprises an amino acid sequence of SEQ ID NO: 104.

82. The polypeptide of clause 77 wherein the VL region consists of an amino acid sequence of SEQ ID NOs: 24, 26, 28, 30, 31, 32, 34, 38, 39, 97, 99 or 104.

83. The polypeptide of clause 82 wherein the VL region consists of an amino acid sequence of SEQ ID NO: 38.

84. The polypeptide of clause 82 wherein the VL region consists of an amino acid sequence of SEQ ID NO: 99.

85. The polypeptide of clause 82 wherein the VL region consists of an amino acid sequence of SEQ ID NO: 104.

86. The polypeptide of any one of clauses 1 to 85 wherein the polypeptide comprises
   (a) a VH region comprising SEQ ID NO: 23 and a VL region comprising SEQ ID NO: 24;
   (b) a VH region comprising SEQ ID NO: 25 and a VL region comprising SEQ ID NO: 26;
   (c) a VH region comprising SEQ ID NO: 27 and a VL region comprising SEQ ID NO: 28;
   (d) a VH region comprising SEQ ID NO: 29 and a VL region comprising SEQ ID NO: 30;

(e) a VH region comprising SEQ ID NO: 27 and a VL region comprising SEQ ID NO: 31;
   (f) a VH region comprising SEQ ID NO: 27 and a VL region comprising SEQ ID NO: 32;
   (g) a VH region comprising SEQ ID NO: 33 and a VL region comprising SEQ ID NO: 34;
   (h) a VH region comprising SEQ ID NO: 33 and a VL region comprising SEQ ID NO: 39;
   (i) a VH region comprising SEQ ID NO: 35 and a VL region comprising SEQ ID NO: 39;
   (j) a VH region comprising SEQ ID NO: 36 and a VL region comprising SEQ ID NO: 39;
   (k) a VH region comprising SEQ ID NO: 37 and a VL region comprising SEQ ID NO: 39;
   (l) a VH region comprising SEQ ID NO: 36 and a VL region comprising SEQ ID NO: 38;
   (m) a VH region comprising SEQ ID NO: 37 and a VL region comprising SEQ ID NO: 38,
   (n) a VH region comprising SEQ ID NO: 96 and a VL region comprising SEQ ID NO: 97;
   (o) a VH region comprising SEQ ID NO: 36 and a VL region comprising SEQ ID NO: 99;
   (p) a VH region comprising SEQ ID NO: 102 and a VL region comprising SEQ ID NO: 99 or
   (q) a VH region comprising SEQ ID NO: 102 and a VL region comprising SEQ ID NO: 104.

87. The polypeptide of clause 86 wherein the polypeptide comprises
   (a) a VH region consisting of SEQ ID NO: 23 and a VL region consisting of SEQ ID NO: 24;
   (b) a VH region consisting of SEQ ID NO: 25 and a VL region consisting of SEQ ID NO: 26,
   (c) a VH region consisting of SEQ ID NO: 27 and a VL region consisting of SEQ ID NO: 28,
   (d) a VH region consisting of SEQ ID NO: 29 and a VL region consisting of SEQ ID NO: 30,
   (e) a VH region consisting of SEQ ID NO: 27 and a VL region consisting of SEQ ID NO: 31,
   (f) a VH region consisting of SEQ ID NO: 27 and a VL region consisting of SEQ ID NO: 32,
   (g) a VH region consisting of SEQ ID NO: 33 and a VL region consisting of SEQ ID NO: 34;
   (h) a VH region consisting of SEQ ID NO: 33 and a VL region consisting of SEQ ID NO: 39,
   (i) a VH region consisting of SEQ ID NO: 35 and a VL region consisting of SEQ ID NO: 39,
   (j) a VH region consisting of SEQ ID NO: 36 and a VL region consisting of SEQ ID NO: 39,
   (k) a VH region consisting of SEQ ID NO: 37 and a VL region consisting of SEQ ID NO: 39;
   (l) a VH region consisting of SEQ ID NO: 36 and a VL region consisting of SEQ ID NO: 38,
   (m) a VH region consisting of SEQ ID NO: 37 and a VL region consisting of SEQ ID NO: 38,
   (n) a VH region consisting of SEQ ID NO: 96 and a VL region consisting of SEQ ID NO: 97;
   (o) a VH region consisting of SEQ ID NO: 36 and a VL region consisting of SEQ ID NO: 99,
   (p) a VH region consisting of SEQ ID NO: 102 and a VL region consisting of SEQ ID NO: 99 or
   (q) a VH region consisting of SEQ ID NO: 102 and a VL region consisting of SEQ ID NO: 104.

88. The polypeptide of any one of clauses 1 to 87 wherein residue H53 is arginine.

89. The polypeptide of any one of clauses 1 to 88 wherein residue H100 is arginine 90. The polypeptide of any one of clauses 1 to 89 wherein residue H100A is tyrosine.

91. The polypeptide of any one of clauses 1 to 90 wherein residue L50 is tyrosine.

92. The polypeptide of any one of clauses 1 to 91 wherein residue L91 is histidine.

93. The polypeptide of any one of clauses 1 to 92 wherein the residue corresponding to position 74 of SEQ ID NO: 70 is lysine or threonine.

94. The polypeptide of any one of clauses 1 to 93 wherein the residue corresponding to position 47 of SEQ ID NO: 418 is tryptophan, the residue corresponding to position 103 of SEQ ID NO: 418 is glycine, the residue corresponding to position 105 of SEQ ID NO: 418 is tyrosine, the residue corresponding to position 31 of SEQ ID NO: 39 is tyrosine, and the residue corresponding to position 92 of SEQ ID NO: 39 is tyrosine.

95. The polypeptide of clause 94 wherein the residue corresponding to position 52 of SEQ ID NO: 418 is leucine, the residue corresponding to position 54 of SEQ ID NO: 418 is arginine, the residue corresponding to position 104 of SEQ ID NO: 418 is arginine, the residue corresponding to position 26 of SEQ ID NO: 39 is serine, the residue corresponding to position 27 of SEQ ID NO: 39 is glutamine, the residue corresponding to position 49 of SEQ ID NO: 39 is tyrosine, and the residue corresponding to position 91 of SEQ ID NO: 39 is histidine.

96. The polypeptide of clause 95 wherein the residue corresponding to position 55 of SEQ ID NO: 418 is serine, the residue corresponding to position 58 of SEQ ID NO: 418 is threonine, the residue corresponding to position 59 of SEQ ID NO: 418 is asparagine, the residue corresponding to position 62 of SEQ ID NO: 418 is glutamine, the residue corresponding to position 100 of SEQ ID NO: 418 is phenylalanine, the residue corresponding to position 1 of SEQ ID NO: 39 is serine, the residue corresponding to position 29 of SEQ ID NO: 39 is valine, the residue corresponding to position 90 of SEQ ID NO: 39 is histidine, and the residue corresponding to position 93 of SEQ ID NO: 39 is serine.

97. The polypeptide of clause 96 wherein the residue corresponding to position 31 of SEQ ID NO: 418 is serine, the residue corresponding to position 60 of SEQ ID NO: 418 is tyrosine, the residue corresponding to position 61 of SEQ ID NO: 418 is asparagine, the residue corresponding to position 65 of SEQ ID NO: 418 is threonine, the residue corresponding to position 99 of SEQ ID NO: 418 is aspartic acid, the residue corresponding to position 101 of SEQ ID NO: 418 is arginine, the residue corresponding to position 102 of SEQ ID NO: 418 is serine, the residue corresponding to position 25 of SEQ ID NO: 39 is alanine, the residue corresponding to position 30 of SEQ ID NO: 39 is arginine, the residue corresponding to position 67 of SEQ ID NO: 39 is serine, the residue corresponding to position 89 of SEQ ID NO: 39 is glutamine, and the residue corresponding to position 94 of SEQ ID NO: 39 is serine.

98. The polypeptide of clause 1 wherein the polypeptide comprises a HCDR1 comprising a sequence having at least 40%, such as at least 60%, such as at least 80% identity with SEQ ID NO: 107.

99. The polypeptide of clause 98 wherein the polypeptide comprises a HCDR1 consisting of a sequence having at least 40%, such as at least 60%, such as at least 80% identity with SEQ ID NO: 107.

100. The polypeptide of clause 99 wherein the polypeptide comprises a HCDR1 comprising SEQ ID NO: 107.

101. The polypeptide of any one of clause 100 wherein the polypeptide comprises a HCDR1 consisting of SEQ ID NO: 107.

102. The polypeptide of any one of clauses 1 or 98 to 101 wherein the polypeptide comprises a HCDR2 comprising a sequence having at least 50%, such as at least 60%, such as at least 70%, such as at least 80%, such as at least 85%, such as at least 90% identity with SEQ ID NO: 108.

103. The polypeptide of clause 102 wherein the polypeptide comprises a HCDR2 consisting of a sequence having at least 50%, such as at least 60%, such as at least 70%, such as at least 80%, such as at least 85%, such as at least 90% identity with SEQ ID NO: 108.

104. The polypeptide of clause 103 wherein the polypeptide comprises a HCDR2 comprising SEQ ID NO: 108.

105. The polypeptide of clause 104 wherein the polypeptide comprises a HCDR2 consisting of SEQ ID NO: 108.

106. The polypeptide of any one of clauses 1 or 98 to 105 wherein the polypeptide comprises a HCDR3 comprising a sequence having at least 60%, such as at least 70%, such as at least 80%, such as at least 90% identity with SEQ ID NO: 109.

107. The polypeptide of clause 106 wherein the polypeptide comprises a HCDR3 consisting of a sequence having at least 60%, such as at least 70%, such as at least 80%, such as at least 90% identity with SEQ ID NO: 109.

108. The polypeptide of clause 107 wherein the polypeptide comprises a HCDR3 comprising SEQ ID NO: 109.

109. The polypeptide of clause 108 wherein the polypeptide comprises a HCDR3 consisting of SEQ ID NO: 109.

110. The polypeptide of any one of clauses 1 or 98 to 109 wherein the polypeptide comprises a LCDR1 comprising a sequence having at least 60%, such as at least 70%, such as at least 80%, such as at least 90% identity with SEQ ID NO: 110.

111. The polypeptide of clause 110 wherein the polypeptide comprises a LCDR1 consisting of a sequence having at least 60%, such as at least 70%, such as at least 80%, such as at least 90% identity with SEQ ID NO: 110.

112. The polypeptide of clause 111 wherein the polypeptide comprises a LCDR1 comprising SEQ ID NO: 110.

113. The polypeptide of clause 112 wherein the polypeptide comprises a LCDR1 consisting of SEQ ID NO: 110.

114. The polypeptide of any one of clauses 1 or 98 to 113 wherein the polypeptide comprises a LCDR2 comprising a sequence having at least 50% identity, such as at least 60%, such as at least 70%, such as at least 80% identity with SEQ ID NO: 111.

115. The polypeptide of clause 114 wherein the polypeptide comprises a LCDR2 consisting of a sequence having at least 50% identity, such as at least 60%, such as at least 70%, such as at least 80% identity with SEQ ID NO: 111.

116. The polypeptide of clause 115 wherein the polypeptide comprises a LCDR2 comprising SEQ ID NO: 111.

117. The polypeptide of clause 116 wherein the polypeptide comprises a LCDR2 consisting of SEQ ID NO: 111.

118. The polypeptide of any one of clauses 1 or 98 to 117 wherein the polypeptide comprises a LCDR3 comprising a sequence having at least 50%, such as at least 60%, such as at least 70%, such as at least 80% identity with SEQ ID NO: 112.

119. The polypeptide of clause 118 wherein the polypeptide comprises a LCDR3 consisting of a sequence having at least 50%, such as at least 60%, such as at least 70%, such as at least 80% identity with SEQ ID NO: 112.

120. The polypeptide of clause 119 wherein the polypeptide comprises a LCDR3 comprising SEQ ID NO: 112.

121. The polypeptide of clause 120 wherein the polypeptide comprises a LCDR3 consisting of SEQ ID NO: 112.

122. The polypeptide of clause 1 wherein the polypeptide comprises a VH region comprising an amino acid sequence having at least 60%, such as at least 70%, such as at least 80%, such as at least 90%, such as at least 95%, such as at least 98%, such as at least 99% sequence identity with SEQ ID NO: 113.

123. The polypeptide of clause 122 wherein the VH region consists of an amino acid sequence having at least 60%, such as at least 70%, such as at least 80%, such as at least 90%, such as at least 95%, such as at least 98%, such as at least 99% sequence identity with SEQ ID NO: 113.

124. The polypeptide of clause 123 wherein the VH region comprises an amino acid sequence of SEQ ID NO: 113.

125. The polypeptide of clause 124 wherein the VH region consists of an amino acid sequence of SEQ ID NO: 113.

126. The polypeptide of any one of clauses 1 or 122 to 125 wherein the polypeptide comprises a VL region comprising an amino acid sequence having at least 60%, such as at least 70%, such as at least 80%, such as at least 90%, such as at least 95%, such as at least 98%, such as at least 99% sequence identity with SEQ ID NO: 114.

127. The polypeptide of any clause 126 wherein the VL region consists of an amino acid sequence having at least 60%, such as at least 70%, such as at least 80%, such as at least 90%, such as at least 95%, such as at least 98%, such as at least 99% sequence identity with SEQ ID NO: 114.

128. The polypeptide of clause 127 wherein the VL region comprises an amino acid sequence of SEQ ID NO: 114.

129. The polypeptide of clause 128 wherein the VL region consists of an amino acid sequence of SEQ ID NO: 114.

130. The polypeptide of any one of clauses 1 to 129 wherein the polypeptide comprises a heavy chain constant region.

131. The polypeptide of clause 130 wherein the heavy chain constant region comprises a polypeptide sequence having at least 50%, such as at least 70%, such as at least 90% identity with SEQ ID NO: 1375.

132. The polypeptide of clause 131 wherein the heavy chain constant region comprises SEQ ID NO: 1375.

133. The polypeptide of clause 132 wherein the heavy chain constant region consists of SEQ ID NO: 1375.

134. The polypeptide of any one of clauses 130 to 133 wherein the heavy chain region comprises a polypeptide sequence having at least 50%, such as at least 70%, such as at least 90% identity with SEQ ID NO: 58, SEQ ID NO: 60 or SEQ ID NO: 1220.

135. The polypeptide of clause 134 wherein the heavy chain region comprises SEQ ID NO: 58, SEQ ID NO: 60 or SEQ ID NO: 1220.

136. The polypeptide of clause 135 wherein the heavy chain region consists of SEQ ID NO: 58, SEQ ID NO: 60 or SEQ ID NO: 1220.

137. The polypeptide of any one of clauses 130 to 136 wherein the heavy chain constant region comprises or consists of IgG1 heavy chain constant region, such as human IgG1.

138. The polypeptide of any one of clauses 1 to 137 wherein the polypeptide comprises a light chain constant region.

139. The polypeptide of clause 138 wherein the light chain constant region comprises a polypeptide sequence having at least 50%, such as at least 70%, such as at least 90% identity with SEQ ID NO: 57.

140. The polypeptide of clause 139 wherein the light chain constant region comprises SEQ ID NO: 57.

141. The polypeptide of clause 140 wherein the light chain constant region consists of SEQ ID NO: 57.

142. The polypeptide of any one of clauses 138 to 141 wherein the light chain region comprises a polypeptide sequence having at least 50%, such as at least 70%, such as at least 90% identity with SEQ ID NO: 59, SEQ ID NO: 61, SEQ ID NO: 1219 or SEQ ID NO: 1221.

143. The polypeptide of clause 142 wherein the light chain region comprises SEQ ID NO: 59, SEQ ID NO: 61, SEQ ID NO: 1219 or SEQ ID NO: 1221.

144. The polypeptide of clause 143 wherein the light chain region consists of SEQ ID NO: 59, SEQ ID NO: 61, SEQ ID NO: 1219 or SEQ ID NO: 1221.

145. The polypeptide of any one of clauses 138 to 144 wherein the light chain constant region comprises or consists of kappa light chain constant region, such as human kappa light chain.

146. The polypeptide of any one of clauses 1 to 145, wherein the polypeptide comprises a VH and a VL region and the VH and VL region are joined by a linker, such as a polypeptide linker.

147. The polypeptide of clause 146, wherein the linker comprises a $(\mathrm{Gly_4Ser})_n$ format (SEQ ID NO: 69), wherein n=1 to 8.

148. The polypeptide of any one of clauses 1 to 147 wherein the LPAR1 is human LPAR1.

149. The polypeptide of any one of clauses 1 to 148 wherein the LPAR1 is native LPAR1.

150. The polypeptide of any one of clauses 1 to 149 wherein the LPAR1 is full length LPAR1.

151. The polypeptide of any one of clauses 1 to 148 wherein the LPAR1 is a fragment of LPAR1.

152. The polypeptide of clause 151 wherein the fragment of LPAR1 comprises the extracellular region of LPAR1.

153. The polypeptide of either clause 151 or 152 wherein the fragment of LPAR1 is at least 50 amino acids long, such as at least 100 amino acids long, such as at least 150 amino acids long, such as at least 200 amino acids long, such as at least 250 amino acids long, such as at least 300 amino acids long, such as at least 350 amino acids long.

154. The polypeptide of any one of clauses 1 to 153 wherein the LPAR1 comprises a sequence having at least 60%, such as at least 70%, such as at least 80%, such as at least 90%, such as at least 95%, such as at least 99% identity with SEQ ID NO: 62, SEQ ID NO: 63 or SEQ ID NO: 64.

155. The polypeptide of clause 154 wherein the LPAR1 consists of a sequence having at least 60%, such as at least 70%, such as at least 80%, such as at least 90%, such as at least 95%, such as at least 99% identity with SEQ ID NO: 62, SEQ ID NO: 63 or SEQ ID NO: 64.

156. The polypeptide of clause 155 wherein the LPAR1 comprises SEQ ID NO: 62, SEQ ID NO: 63 or SEQ ID NO: 64.

157. The polypeptide of clause 156 wherein the LPAR1 consists of SEQ ID NO: 62, SEQ ID NO: 63 or SEQ ID NO: 64.

158. The polypeptide of any one of clauses 1 to 157 wherein the polypeptide binds to functionally active LPAR1.

159. The polypeptide of any one of clauses 1 to 158 wherein the LPAR1 is on the surface of a cell.

160. The polypeptide of clause 159 wherein the cell is a living cell.

161. The polypeptide of any one of clauses 1 to 160 wherein the polypeptide modulates the function of LPAR1.

162. The polypeptide of clause 161 wherein the polypeptide is an inhibitor of LPAR1.

163. The polypeptide of clause 162 wherein the polypeptide is an allosteric inhibitor of LPAR1.

164. The polypeptide of any one of clauses 161 to 163 wherein the polypeptide is an inverse agonist of LPAR1.

165. The polypeptide of any one of clauses 1 to 164 wherein binding to LPAR1 reduces Gi/o signalling by the LPAR1.

166. The polypeptide of any one of clauses 1 to 165 wherein binding to LPAR1 reduces or prevents LPA-induced or constitutive reduction in cAMP production.

167. The polypeptide of clause 166 wherein binding to LPAR1 increases cAMP production in the HTRF cAMP assay.

168. The polypeptide of any one of clauses 1 to 167 wherein binding to LPAR1 reduces or prevents LPA-induced calcium mobilisation.

169. The polypeptide of clause 168 wherein binding to LPAR1 reduces calcium mobilisation in the assay detailed in Example 1.8.

170. The polypeptide of any one of clauses 1 to 169 wherein the polypeptide on binding to LPAR1 reduces the activity of LPAR1 by at least 10%, such as at least 20%, such as at least 30%, such as at least 40%, such as at least 50%, such as at least 60%, such as at least 70%, such as at least 80%, such as at least 90%, such as at least 95%, such as at least 98%, such as at least 99%, such as at least 100%.

171. The polypeptide of clause 170 wherein the activity of LPAR1 is indicated by the HTRF cAMP assay.

172. The polypeptide of any one of clauses 1 to 171 wherein the polypeptide binds to LPAR1 with a $K_D$ of less than 150 nM, such as less than 30 nM, such as less than 15 nM, especially less than 1.5 nM.

173. The polypeptide of clause 172 wherein the $K_D$ is measured using a kinetic exclusion assay.

174. The polypeptide of any one of clauses 1 to 173 wherein the polypeptide binds to an epitope of human LPAR1 comprising at least one of amino acids 30-44 of full length LPAR1 (SEQ ID NO: 62).

175. The polypeptide of clause 174 wherein the polypeptide binds to an epitope of human LPAR1 comprising amino acids 35 and 36 of full length LPAR1 (SEQ ID NO: 62).

176. The polypeptide of either clause 174 or 175 wherein the polypeptide binds to an epitope of human LPAR1 comprising amino acids 37 and 38 of full length LPAR1 (SEQ ID NO: 62).

177. The polypeptide of any one of clauses 174 to 176 wherein the polypeptide binds to an epitope of human LPAR1 comprising amino acids 32, 39, 40 and 41 of full length LPAR1 (SEQ ID NO: 62).

178. The polypeptide of any one of clauses 174 to 177 wherein the polypeptide binds to an epitope of human LPAR1 comprising at least five of amino acids 30-44 of full length LPAR1 (SEQ ID NO: 62).

179. The polypeptide of clause 178 wherein the polypeptide binds to an epitope of human LPAR1 comprising at least ten of amino acids 30-44 of full length LPAR1 (SEQ ID NO: 62).

180. The polypeptide of clause 179 wherein the polypeptide binds to an epitope of human LPAR1 comprising amino acids 30-44 of full length LPAR1 (SEQ ID NO: 62).

181. The polypeptide of any one of clauses 1 to 180 wherein the polypeptide binds to an epitope of human LPAR1 comprising at least one of amino acids 106-120 of full length LPAR1 (SEQ ID NO: 62).

182. The polypeptide of clause 181 wherein the polypeptide binds to an epitope of human LPAR1 comprising amino acid 114 of full length LPAR1 (SEQ ID NO: 62).

183. The polypeptide of either clause 181 or 182 wherein the polypeptide binds to an epitope of human LPAR1 comprising at least five of amino acids 106-120 of full length LPAR1 (SEQ ID NO: 62).

184. The polypeptide of clause 183 wherein the polypeptide binds to an epitope of human LPAR1 comprising at least ten of amino acids 106-120 of full length LPAR1 (SEQ ID NO: 62).

185. The polypeptide of clause 184 wherein the polypeptide binds to an epitope of human LPAR1 comprising amino acids 106-120 of full length LPAR1 (SEQ ID NO: 62).

186. The polypeptide of any one of clauses 1 to 185 wherein the polypeptide binds to an epitope of human LPAR1 comprising at least one of amino acids 190-204 of full length LPAR1 (SEQ ID NO: 62).

187. The polypeptide of clause 186 wherein the polypeptide binds to an epitope of human LPAR1 comprising amino acid 193 of full length LPAR1 (SEQ ID NO: 62).

188. The polypeptide of either clause 186 or 187 wherein the polypeptide binds to an epitope of human LPAR1 comprising amino acids 191, 192, 194 and 197 of full length LPAR1 (SEQ ID NO: 62).

189. The polypeptide of any one of clauses 186 to 188 wherein the polypeptide binds to an epitope of human LPAR1 comprising amino acid 190 of full length LPAR1 (SEQ ID NO: 62).

190. The polypeptide of any one of clauses 186 to 189 wherein the polypeptide binds to an epitope of human LPAR1 comprising at least five of amino acids 190-204 of full length LPAR1 (SEQ ID NO: 62).

191. The polypeptide of clause 190 wherein the polypeptide binds to an epitope of human LPAR1 comprising at least ten of amino acids 190-204 of full length LPAR1 (SEQ ID NO: 62).

192. The polypeptide of clause 191 wherein the polypeptide binds to an epitope of human LPAR1 comprising amino acids 190-204 of full length LPAR1 (SEQ ID NO: 62).

193. The polypeptide of any one of clauses 1 to 192 wherein the polypeptide binds to an epitope of human LPAR1 comprising at least one of amino acids 280-294 of full length LPAR1 (SEQ ID NO: 62).

194. The polypeptide of clause 193 wherein the polypeptide binds to an epitope of human LPAR1 comprising amino acid 286 of full length LPAR1 (SEQ ID NO: 62).

195. The polypeptide of either clause 193 or 194 wherein the polypeptide binds to an epitope of human LPAR1 comprising amino acids 285 of full length LPAR1 (SEQ ID NO: 62).

196. The polypeptide of any one of clauses 193 to 195 wherein the polypeptide binds to an epitope of human LPAR1 comprising at least five of amino acids 280-294 of full length LPAR1 (SEQ ID NO: 62).

197. The polypeptide of clause 196 wherein the polypeptide binds to an epitope of human LPAR1 comprising at least ten of amino acids 280-294 of full length LPAR1 (SEQ ID NO: 62).

198. The polypeptide of clause 197 wherein the polypeptide binds to an epitope of human LPAR1 comprising amino acids 280-294 of full length LPAR1 (SEQ ID NO: 62).

199. The polypeptide of any one of clauses 1 to 198 wherein the polypeptide binds to an epitope of human LPAR1 comprising amino acids 30-44, 106-120, 190-204 and 280-294 of full length LPAR1 (SEQ ID NO: 62).

200. The polypeptide of clause 199 wherein the polypeptide binds to an epitope of human LPAR1 consisting of amino acids 30-44, 106-120, 190-204 and 280-294 of full length LPAR1 (SEQ ID NO: 62).

201. The polypeptide of any one of clauses 1 to 173 wherein the polypeptide binds to an epitope of LPAR1 comprising one or more of residues 35, 36, 193 or 286 of full length LPAR1 (SEQ ID NO: 62).

202. The polypeptide of clause 201 wherein the polypeptide binds to an epitope of LPAR1 comprising residue 35 of full length LPAR1 (SEQ ID NO: 62).

203. The polypeptide of clause 201 wherein the polypeptide binds to an epitope of LPAR1 comprising residue 36 of full length LPAR1 (SEQ ID NO: 62).

204. The polypeptide of clause 201 wherein the polypeptide binds to an epitope of LPAR1 comprising residue 193 of full length LPAR1 (SEQ ID NO: 62).

205. The polypeptide of clause 201 wherein the polypeptide binds to an epitope of LPAR1 comprising residue 286 of full length LPAR1 (SEQ ID NO: 62).

206. The polypeptide of any one of clauses 1 to 205 wherein the polypeptide binds to a conformational epitope of human LPAR1 comprising one or more residues located within the N-terminal capping helix and one or more residues located within the extracellular domain 2.

207. The polypeptide of clause 206 wherein the polypeptide binds to an epitope of LPAR1 comprising residues 36 and 193 of full length LPAR1 (SEQ ID NO: 62).

208. A polypeptide wherein the polypeptide binds to the same, or essentially the same, epitope as, a polypeptide as defined in any one of clauses 1 to 207.

209. A polypeptide wherein the polypeptide competes with a polypeptide as defined in any one of clauses 1 to 208 for binding to LPAR1.

210. The polypeptide of any one of clauses 1 to 209 wherein the polypeptide is an antibody or fragment thereof.

211. The polypeptide of clause 210 wherein the antibody or fragment thereof is selected from the list consisting of an scFv, Fab, Fab', F(ab')2, Fv, variable domain (e.g. VH or VL), diabody, minibody or full length antibody.

212. The polypeptide of clause 211, wherein the antibody or fragment thereof is selected from the list consisting of an scFv, Fab or a full length antibody.

213. The polypeptide of clause 212, wherein the antibody or fragment thereof is a full length antibody or Fab.

214. The polypeptide of clause 213, wherein the full length antibody is an IgG1 antibody.

215. The polypeptide of any one of clauses 210 to 214 wherein the heavy chain constant region of the antibody comprises one or more mutations to reduce effector function, extend half-life, alter ADCC or improve hinge stability.

216. The polypeptide of clause 215 wherein the heavy chain constant region comprises any one of SEQ ID NOs: 56, 1235, 1376 and 1377.

217. The polypeptide of any one of clauses 210 to 214 or 216 wherein the heavy chain constant region of the antibody comprises one or more of the following residues:

residue at position 250 is Q, residue at position 252 is Y, residue at position 252 is F, residue at position 252 is W, residue at position 252 is T, residue at position 253 is A, residue at position 254 is T, residue at position 256 is E, residue at position 256 is S, residue at position 256 is R, residue at position 256 is Q, residue at position 256 is D, residue at position 259 is I, residue at position 285 is D, residue at position 285 is N, residue at position 286 is D, residue at position 294 is deleted, residue at position 307 is A, residue at position 307 is Q, residue at position 307 is P, residue at position 307 is R, residue at position 307 is W, residue at position 308 is P, residue at position 308 is F, residue at position 309 is P, residue at position 309 is D, residue at position 309 is N, residue at position 310 is A, residue at position 311 is S, residue at position 311 is I, residue at position 311 is V, residue at position 311 is H, residue at position 315 is D, residue at position 378 is V, residue at position 380 is A, residue at position 385 is R, residue at position 385 is D, residue at position 385 is S, residue at position 385 is T, residue at position 385 is H, residue at position 385 is K, residue at position 385 is A, residue at position 385 is G, residue at position 386 is T, residue at position 386 is P, residue at position 386 is D, residue at position 386 is S, residue at position 386 is K, residue at position 386 is R, residue at position 386 is I, residue at position 386 is M, residue at position 387 is R, residue at position 387 is P, residue at position 387 is H, residue at position 387 is S, residue at position 387 is T, residue at position 387 is A, residue at position 389 is P, residue at position 389 is S, residue at position 389 is N, residue at position 428 is L, residue at position 433 is K, residue at position 433 is R, residue at position 433 is S, residue at position 433 is I, residue at position 433 is P, residue at position 433 is Q, residue at position 434 is F, residue at position 434 is H, residue at position 434 is Y, residue at position 434 is A, residue at position 434 is S, residue at position 435 is A, residue at position 436 is H, residue at position 436 is I or residue at position 436 is V.

218. The polypeptide of clause 215 wherein the mutations are selected from the mutations listed in Table 2.

219. The polypeptide of clause 218 wherein the heavy chain constant region comprises the mutations M252Y, S254T and T256E or M428L and N434S.

220. The polypeptide of any one of clauses 217 to 219 wherein the heavy chain constant region comprises any one of SEQ ID NOs: 1237 to 1367.

221. The polypeptide of clause 220 wherein the heavy chain constant region consists of any one of SEQ ID NOs: 1237 to 1367.

222. The polypeptide of any one of clauses 210 to 221, wherein the antibody or fragment thereof is a human antibody or fragment thereof.

223. A construct comprising the polypeptide of any one of clauses 1 to 222.

224. The construct of clause 223 wherein the construct comprises a polypeptide which binds to a target other than LPAR1.

225. A composition comprising the polypeptide or construct of any one of clauses 1 to 224.

226. A pharmaceutical composition comprising the polypeptide or construct of any one of clauses 1 to 225, together with a pharmaceutically acceptable diluent or carrier.

227. The polypeptide, construct or composition of any one of clauses 1 to 226 for use as a medicament.

228. The polypeptide, construct or composition of any one of clauses 1 to 227 for use in the treatment of an inflammatory disease and/or fibrotic disease.

229. The polypeptide, construct or composition of clause 228 for use in the treatment of a disease selected from the list consisting of chronic kidney disease, kidney fibrosis, peritoneal fibrosis, liver fibrosis, pulmonary fibrosis, dermal fibrosis, systemic sclerosis and osteoarthritis.

230. The polypeptide, construct or composition of clause 227 for use in the treatment of a disease selected from the list consisting of chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer.

231. A method of treating an inflammatory disease and/or fibrotic disease in a subject in need thereof, comprising administering to the subject a therapeutically effective amount of the polypeptide, construct or composition of any one of clauses 1 to 226.

232. A method of treating a disease selected from the list consisting of chronic kidney disease, kidney fibrosis, peritoneal fibrosis, liver fibrosis, pulmonary fibrosis, dermal fibrosis, systemic sclerosis and osteoarthritis in a subject in need thereof, comprising administering to the subject a therapeutically effective amount of the polypeptide, construct or composition of any one of clauses 1 to 226.

233. A method of treating a disease selected from the list consisting of chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer in a subject in need thereof, comprising administering to the subject a therapeutically effective amount of the polypeptide, construct or composition of any one of clauses 1 to 226.

234. Use of a polypeptide, construct or composition of any one of clauses 1 to 226 in the manufacture of a medicament for the treatment of an inflammatory disease and/or fibrotic disease.

235. Use of a polypeptide, construct or composition of any one of clauses 1 to 226 in the manufacture of a medicament for the treatment of a disease selected from the list consisting of chronic kidney disease, kidney fibrosis, peritoneal fibrosis, liver fibrosis, pulmonary fibrosis, dermal fibrosis, systemic sclerosis and osteoarthritis.

236. Use of a polypeptide, construct or composition of any one of clauses 1 to 226 in the manufacture of a medicament for the treatment of a disease selected from the list consisting of chronic kidney disease, kidney fibrosis, peritoneal fibrosis, liver fibrosis, pulmonary fibrosis (e.g. idiopathic pulmonary fibrosis), dermal fibrosis, systemic sclerosis, osteoarthritis, NASH, rheumatoid arthritis, neuropathic pain or cancer.

237. A polynucleotide sequence encoding the polypeptide or construct of any one of clauses 1 to 224.

238. The polynucleotide of clause 237 wherein the polynucleotide comprises any one of SEQ ID NOs: 1368 to 1374.

239. The polynucleotide of clause 238 wherein the polynucleotide consists of any one of SEQ ID NOs: 1368 to 1374.

240. An expression vector comprising the polynucleotide sequence of any one of clauses 237 to 239.

241. A cell comprising the polynucleotide sequence of any one of clauses 237 to 239 or the expression vector of clause 240.

Miscellaneous

All references referred to in this application, including patent and patent applications, are incorporated herein by reference to the fullest extent possible.

Throughout the specification and the claims which follow, unless the context requires otherwise, the word 'comprise', and variations such as 'comprises' and 'comprising', will be understood to imply the inclusion of a stated integer, step, group of integers or group of steps but not to the exclusion of any other integer, step, group of integers or group of steps.

The application of which this description and claims forms part may be used as a basis for priority in respect of any subsequent application. The claims of such subsequent application may be directed to any feature or combination of features described herein. They may take the form of product, composition, process, or use claims and may include, by way of example and without limitation, the following claims.

REFERENCES

Binz H K, Stumpp M T, Forrer P, Amstutz P, Pluckthun A. Designing repeat proteins: well-expressed, soluble and stable proteins from combinatorial libraries of consensus ankyrin repeat proteins. Journal of molecular biology. 2003; 332(2):489-503.

Booth B J, Ramakrishnan B, Narayan K, Wollacott A M, Babcock G J, Shriver Z, Viswanathan K. Extending human IgG half-life using structure-guided design. InMAbs 2018 Oct. 3 (Vol. 10, No. 7, pp. 1098-1110). Taylor & Francis.

Borrok M J, Mody N, Lu X, Kuhn M L, Wu H, Dall'Acqua W F, Tsui P. An "Fc-silenced" IgG1 format with extended half-life designed for improved stability. Journal of Pharmaceutical Sciences. 2017 Apr. 1; 106(4):1008-17.

Castelino F V, Seiders J, Bain G, Brooks S F, King C D, Swaney J S, Lorrain D S, Chun J, Luster A D, Tager A M. Amelioration of dermal fibrosis by genetic deletion or pharmacologic antagonism of lysophosphatidic acid receptor 1 in a mouse model of scleroderma. Arthritis Rheum. 2011; 63:1405-15.

Chrencik J E, Roth C B, Terakado M, Kurata H, Omi R, Kihara Y, Warshaviak D, Nakade S, Asmar-Rovira G, Mileni M, Mizuno H, Griffith M T, Rodgers C, Han G W, Velasquez J, Chun J, Stevens R C, Hanson M A (2015) Crystal Structure of Antagonist Bound Human Lysophosphatidic Acid Receptor 1. Cell. 2015 161(7):1633-43

Dall'Acqua W F, Woods R M, Ward E S, Palaszynski S R, Patel N K, Brewah Y A, Wu H, Kiener P A, Langermann S. Increasing the affinity of a human IgG1 for the neonatal Fc receptor: biological consequences. The Journal of Immunology. 2002 Nov. 1; 169(9):5171-80.

Dall'Acqua W F, Kiener P A, Wu H. Properties of human IgG1s engineered for enhanced binding to the neonatal Fc receptor (FcRn). Journal of Biological Chemistry. 2006 Aug. 18; 281(33):23514-24.

Datta-Mannan A, Chow C K, Dickinson C, Driver D, Lu J, Witcher D R, Wroblewski V J. FcRn affinity-pharmacokinetic relationship of five human IgG4 antibodies engineered for improved in vitro FcRn binding properties in cynomolgus monkeys. Drug Metabolism and Disposition. 2012 Aug. 1; 40(8):1545-55.

Datta-Mannan A, Witcher D R, Tang Y, Watkins J, Jiang W, Wroblewski V J. Humanized IgG1 variants with differential binding properties to the neonatal Fc receptor: relationship to pharmacokinetics in mice and primates. Drug metabolism and disposition. 2007 Jan. 1; 35(1):86-94.

Datta-Mannan A, Witcher D R, Tang Y, Watkins J, Wroblewski V J. Monoclonal antibody clearance: impact of modulating the interaction of IgG with the neonatal Fc receptor. Journal of Biological Chemistry. 2007 Jan. 19; 282(3):1709-17.

Forbes E K, Biswas S, Collins K A, Gilbert S C, Hill A V, Draper S J. Combining liver- and blood-stage malaria viral-vectored vaccines: investigating mechanisms of CD8+ T cell interference. The Journal of Immunology. 2011 Oct. 1; 187(7):3738-50.

Hinton P R, Johlfs M G, Xiong J M, Hanestad K, Ong K C, Bullock C, Keller S, Tang M T, Tso J Y, Vasquez M, Tsurushita N. Engineered human IgG antibodies with longer serum half-lives in primates. Journal of Biological Chemistry. 2004 Feb. 1; 279(8):6213-6.

Hinton P R, Xiong J M, Johlfs M G, Tang M T, Keller S, Tsurushita N. An engineered human IgG1 antibody with longer serum half-life. The Journal of Immunology. 2006 Jan. 1; 176(1):346-56.

Hollevoet K, Declerck P J. State of play and clinical prospects of antibody gene transfer. Journal of translational medicine. 2017; 15(1):1-9.

Igawa T, Maeda A, Haraya K, Tachibana T, Iwayanagi Y, Mimoto F, Higuchi Y, Ishii S, Tamba S, Hironiwa N, Nagano K. Engineered monoclonal antibody with novel antigen-sweeping activity in vivo. PloS one. 2013 May 7; 8(5):e63236.

Kabat E A, Te Wu T, Perry H M, Foeller C, Gottesman K S. Sequences of proteins of immunological interest. DIANE publishing; 1991.

Ko S, Jo M, Jung S T. Recent achievements and challenges in prolonging the serum half-lives of therapeutic IgG antibodies through Fc engineering. BioDrugs. 2021 March; 35(2):147-57.

Lee C H, Kang T H, Godon O, Watanabe M, Delidakis G, Gillis C M, Sterlin D, Hardy D, Cogné M, Macdonald L E, Murphy A J. An engineered human Fc domain that behaves like a pH-toggle switch for ultra-long circulation persistence. Nature communications. 2019 Nov. 6; 10(1):1-1.

Lee J H, Sarker M K, Choi H, Shin D, Kim D, Jun H S. Lysophosphatidic acid receptor 1 inhibitor, AM095, attenuates diabetic nephropathy in mice by downregulation of TLR4/NF-κB signaling and NADPH oxidase. Biochim Biophys Acta Mol Basis Dis. 2019; 1865(6):1332-1340

Li H Y, Oh Y S, Choi J W, Jung J Y, Jun H S. Blocking lysophosphatidic acid receptor 1 signaling inhibits diabetic nephropathy in db/db mice. Kidney international. 2017; 91(6):1362-73.

Liu R, Oldham R J, Teal E, Beers S A, Cragg M S. Fc-engineering for modulated effector functions—improving antibodies for cancer treatment. Antibodies. 2020 Nov. 17; 9(4):64.

Mackness B C, Jaworski J A, Boudanova E, Park A, Valente D, Mauriac C, Pasquier O, Schmidt T, Kabiri M, Kandira A, Radoş evio K. Antibody Fc engineering for enhanced neonatal Fc receptor binding and prolonged circulation half-life. InMAbs 2019 Oct. 3 (Vol. 11, No. 7, pp. 1276-1288). Taylor & Francis.

Miyabe C, Miyabe Y, Nagai J, et al. Abrogation of lysophosphatidic acid receptor 1 ameliorates murine vasculitis. Arthritis Res Ther. 2019; 21(1):191

Nishikawa K, Okanari E, Shinohara Y, Matsunaga H, Nishida H, (wase N, Ushiyama S. Therapeutic efficacy of a novel LPA1 receptor antagonist, UD-009, in a bleomycin-induced pulmonary fibrosis model. European Respiratory Journal. 2016; 48: PA4032.

Orosa B, Garcia S, Martinez P, Gonzalez A, Gómez-Reino J J, Conde C. Lysophosphatidic acid receptor inhibition as a new multipronged treatment for rheumatoid arthritis. Annals of the rheumatic diseases. 2014 Jan. 1; 73(1):298-305.

Padlan E A. Anatomy of the antibody molecule. Molecular immunology. 1994; 31(3):169-217.

Palmer S M, Snyder L, Todd J L, et al. Randomized, Double-Blind, Placebo-Controlled, Phase 2 Trial of BMS-986020, a Lysophosphatidic Acid Receptor Antagonist for the Treatment of Idiopathic Pulmonary Fibrosis. Chest. 2018; 154(5):1061-1069.

Petkova S B, Akilesh S, Sproule T J, Christianson G J, Al Khabbaz H, Brown A C, Presta L G, Meng Y G, Roopenian D C. Enhanced half-life of genetically engineered human IgG1 antibodies in a humanized FcRn mouse model: potential application in humorally mediated autoimmune disease. International immunology. 2006 Dec. 1; 18(12):1759-69.

Pradère JP, Klein J, Gres S, et al. LPA1 receptor activation promotes renal interstitial fibrosis. J Am Soc Nephrol. 2007; 18(12):3110-3118

Rancoule C, Attané C, Gres S, et al. Lysophosphatidic acid impairs glucose homeostasis and inhibits insulin secretion in high-fat diet obese mice. Diabetologia. 2013; 56(6):1394-1402

Robbie G J, Criste R, Dall'Acqua W F, Jensen K, Patel N K, Losonsky G A, Griffin M P. A novel investigational Fc-modified humanized monoclonal antibody, motavizumab-YTE, has an extended half-life in healthy adults. Antimicrobial agents and chemotherapy. 2013 December; 57(12):6147-53.

Sakai N, Chun J, Duffield J S, Wada T, Luster A D, Tager A (2013) LPAR1-induced cytoskeleton reorganization drives fibrosis through CTGF-dependent fibroblast proliferation. FASEB J. 2013 May; 27(5):1830-46

Sasagawa T, Suzuki K, Shiota T, Kondo T, Okita M (1998) The significance of plasma lysophospholipids in patients with renal failure on hemodialysis. J Nutr Sci Vitaminol (Tokyo). 1998 December; 44(6):809-18

Saunders K O. Conceptual approaches to modulating antibody effector functions and circulation half-life. Frontiers in immunology. 2019 Jun. 7; 10:1296.

Shields R L, Namenuk A K, Hong K, Meng Y G, Rae J, Briggs J, Xie D, Lai J, Stadlen A, Li B, Fox J A. High resolution mapping of the binding site on human IgG1 for FcγRI, FcγRII, FcγRIII, and FcRn and design of IgG1 variants with improved binding to the FcγR. Journal of Biological Chemistry. 2001 Mar. 2; 276(9):6591-604.

Swaney J S, Chapman C, Correa L D, Stebbins K J, Bundey R A, Prodanovich P C, Fagan P, Baccei C S, Santini A M, Hutchinson J H, Seiders T J, Parr T A, Prasit P, Evans J F, Lorrain D S (2010) A novel, orally active LPA(1) receptor antagonist inhibits lung fibrosis in the mouse bleomycin model. Br J Pharmacol. 2010; 160(7):1699-713

Swaney J S, Chapman C, Correa L D, et al. Pharmacokinetic and pharmacodynamic characterization of an oral lysophosphatidic acid type 1 receptor-selective antagonist. J Pharmacol Exp Ther. 2011; 336(3):693-700

Tager A M, LaCamera P, Shea B S, Campanella G S, Selman M, Zhao Z, Polosukhin V, Wain J, Karimi-Shah B A, Kim N D, Hart W K, Pardo A, Blackwell T S, Xu Y, Chun J, Luster A D (2007) The lysophosphatidic acid receptor LPAR1 links pulmonary fibrosis to lung injury by mediating fibrolast recruitment and vascular leak. Nat Med. 2007 January; 14(1):45-54

Tokumura A, Carbone L D, Yoshioka Y, Morishige J, Kikuchi M, Postlewaite A, Watsky M A (2009) Elevated serum levels of arachidonoyl-lysophosphatidic acid and sphingosine 1-phosphate in systemic sclerosis. Int J Med Sci. 2009 6(4):168-76

Vaccaro C, Bawdon R, Wanjie S, Ober R J, Ward E S. Divergent activities of an engineered antibody in murine and human systems have implications for therapeutic antibodies. Proceedings of the National Academy of Sciences. 2006 Dec. 5; 103(49):18709-14.

Vaccaro C, Zhou J, Ober R J, Ward E S. Engineering the Fc region of immunoglobulin G to modulate in vivo antibody levels. Nature biotechnology. 2005 October; 23(10):1283-8.

Watanabe N, Ikeda H, Nakamura K, Ohkawa R, Kume Y, Tomiya T, Tejima K, Nishikawa T, Arai M, Yanase M, Aoki J. Plasma lysophosphatidic acid level and serum autotaxin activity are increased in liver injury in rats in relation to its severity. Life sciences. 2007 Sep. 1; 81(12):1009-15.

Zalevsky J, Chamberlain A K, Horton H M, Karki S, Leung I W, Sproule T J, Lazar G A, Roopenian D C, Desjarlais J R. Enhanced antibody half-life improves in vivo activity. Nature biotechnology. 2010 February; 28(2):157-9.

Zhang M Z, Wang X, Yang H, et al. Lysophosphatidic Acid Receptor Antagonism Protects against Diabetic Nephropathy in a Type 2 Diabetic Model. J Am Soc Nephrol. 2017; 28(11):3300-3311

US2014/056879A1

U.S. Pat. No. 6,277,375B2

U.S. Pat. No. 8,088,376B2

WO9734631

WO9823289

WO2004029207

WO2004099249

WO2006019447

WO2006053301

WO2009086320

WO201803510

SEQUENCE LISTING (1377 sequences)

SEQ ID NO: 1 - protein, 5 aa, synthetic construct
  REGION 1..5: note = Artificial Sequence
SSGIS

SEQ ID NO: 2 - protein, 17 aa, synthetic construct
  REGION 1..17: note = Artificial Sequence
EILPRSGYTNYNQGFTG

SEQ ID NO: 3 - protein, 11 aa, synthetic construct
  REGION 1..11: note = Artificial Sequence
DFKGGRYAMDY

SEQ ID NO: 4 - protein, 11 aa, synthetic construct
  REGION 1..11: note = Artificial Sequence
QASQSVRYNVA

SEQ ID NO: 5 - protein, 7 aa, synthetic construct
  REGION 1..7: note = Artificial Sequence
YASNRYD

SEQ ID NO: 6 - protein, 9 aa, synthetic construct
  REGION 1..9: note = Artificial Sequence
QHHYSSPLT

SEQ ID NO: 7 - protein, 5 aa, synthetic construct
  REGION 1..5: note = Artificial Sequence
SYGIS

SEQ ID NO: 8 - protein, 17 aa, synthetic construct
  REGION 1..17: note = Artificial Sequence
EILPRSGYTNYNEKFKG

SEQ ID NO: 9 - protein, 17 aa, synthetic construct
  REGION 1..17: note = Artificial Sequence
EIYPRSGNTYYNEKFKG

SEQ ID NO: 10 - protein, 17 aa, synthetic construct
  REGION 1..17: note = Artificial Sequence
EIYPRSGYTNYNEKFKG

SEQ ID NO: 11 - protein, 17 aa, synthetic construct
  REGION 1..17: note = Artificial Sequence
EILPRSGYTNYNEGFTG

SEQ ID NO: 12 - protein, 11 aa, synthetic construct
  REGION 1..11: note = Artificial Sequence
DFGSSRYAMDY

SEQ ID NO: 13 - protein, 11 aa, synthetic construct
  REGION 1..11: note = Artificial Sequence
DYGSSRYAMDY

SEQ ID NO: 14 - protein, 11 aa, synthetic construct
  REGION 1..11: note = Artificial Sequence
DYDNSRYALDY

SEQ ID NO: 15 - protein, 11 aa, synthetic construct
  REGION 1..11: note = Artificial Sequence
DKGPSRYTMDY

SEQ ID NO: 16 - protein, 11 aa, synthetic construct
  REGION 1..11: note = Artificial Sequence
KASQSVRYNVA

SEQ ID NO: 17 - protein, 11 aa, synthetic construct
  REGION 1..11: note = Artificial Sequence
KASQSVGNNVA

SEQ ID NO: 18 - protein, 11 aa, synthetic construct
  REGION 1..11: note = Artificial Sequence
KASQSVGYNVA

SEQ ID NO: 19 - protein, 7 aa, synthetic construct
  REGION 1..7: note = Artificial Sequence
YASNRYT

SEQ ID NO: 20 - protein, 10 aa, synthetic construct
  REGION 1..10: note = Artificial Sequence
QQHYNSPLTF

SEQ ID NO: 21 - protein, 10 aa, synthetic construct
  REGION 1..10: note = Artificial Sequence
QQHYSSPLTF

SEQ ID NO: 22 - protein, 10 aa, synthetic construct
  REGION 1..10: note = Artificial Sequence
QHHYNSPLTF

SEQ ID NO: 23 - protein, 120 aa, synthetic construct
  REGION 1..120: note = Artificial Sequence
QVQLQQSGAELARPGASVKLSCKASGYTFTSSGISWVKQRTGQGLEWIGEILPRSGYTNYNEKFKGKASLTADKSSSTAYMELRSLTSEDSAVYFCARDFGSSRYAMDYWSQGTSVTVSS

SEQ ID NO: 24 - protein, 107 aa, synthetic construct
  REGION 1..107: note = Artificial Sequence
SIVMTQTPKLLPVSAGDRVTMTCKASQSVRYNVAWYQQKPGQSPKLLIYYASNRYTGVPDRFTGSGSGTDFTFTVRSVQVEDLAVYFCQQHYNSPLTFGSGTKLELR

SEQ ID NO: 25 - protein, 120 aa, synthetic construct
  REGION 1..120: note = Artificial Sequence
QVQLQQSGAELARPGASVKLSCKASGYTFTSYGISWVKQRTGQGLEWIGEIYPRSGNTYYNEKFKGKATLTADKSSSTAYMELRSLTSEDSAVYFCARDYGSSRYAMDYWGQGTSVTVSS

SEQ ID NO: 26 - protein, 107 aa, synthetic construct
  REGION 1..107: note = Artificial Sequence
SIVMTQTPKFLPVSAGDRVTMTCKASQSVGNNVAWYQQKPGQSPKLLIYYASNRYTGVPDRFTGSGSGTDFTFTISSVQVEDLAVYFCQQHYSSPLTFGAGTKLELK

SEQ ID NO: 27 - protein, 120 aa, synthetic construct
  REGION 1..120: note = Artificial Sequence
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGSSRYAMDYWGQGTSVTVSS

SEQ ID NO: 28 - protein, 107 aa, synthetic construct
  REGION 1..107: note = Artificial Sequence
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYNSPLTFGAGTKLELK

SEQ ID NO: 29 - protein, 120 aa, synthetic construct
  REGION 1..120: note = Artificial Sequence
QVQLQQSGAELARPGASVKLSCKASGYTFTSSGISWVKQRTGQGLEWIGEIYPRSGYTNYNEKFKGKASLTADKSSRTAYMELRSLTSEDSAVYFCARDYDNSRYALDYWGQGTSVTVSS

SEQ ID NO: 30 - protein, 107 aa, synthetic construct
  REGION 1..107: note = Artificial Sequence
SIVMTQTPKFLPVSAGDRVTMTCKASQSVGYNVAWYQQKTGQSPKLLIYYASNRYTGVPDRFTGSGSGTDFTFTISSVQVEDLAVYFCQHHYSSPLTFGAGTKLELK

SEQ ID NO: 31 - protein, 107 aa, synthetic construct
  REGION 1..107: note = Artificial Sequence
SIVMTQTPKFLPVSAGDRVTMTCKASQSVRYNVAWYQQKPGQSPKLLIYYASNRYTGVPDRFTGSGSGTDFTFTISSVQVEDLAVYFCQHHYNSPLTFGAGTKLELK

SEQ ID NO: 32 - protein, 107 aa, synthetic construct
  REGION 1..107: note = Artificial Sequence
SIVMTQTPKFLPVSAGDRVTMTCKASQSVRYNVAWYQQKPGQSPKLLIYYASNRYTGVPDRFTGSGSGTDFTFTISSVQVEDLAVYFCQHHYSSPLTFGAGTKLELK

SEQ ID NO: 33 - protein, 120 aa, synthetic construct
  REGION 1..120: note = Artificial Sequence
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSSRYAMDYWGQGTTVTVSS

SEQ ID NO: 34 - protein, 107 aa, synthetic construct
  REGION 1..107: note = Artificial Sequence
SIQMTQSPSSLSASVGDRVTITCQASQSVRYNVAWYQQKPGKAPKLLIYYASNRYTGVPSRFSGSGSGTDFTFTISSLQPEDIATYFCQQHYNSPLTFGGGTKLEIK

SEQ ID NO: 35 - protein, 120 aa, synthetic construct
  REGION 1..120: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSSRYAMDYWGQGTTVTVSS

SEQ ID NO: 36 - protein, 120 aa, synthetic construct
  REGION 1..120: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGGRYAMDYWGQGTTVTVSS

SEQ ID NO: 37 - protein, 120 aa, synthetic construct
  REGION 1..120: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPSRYTMDYWGQGTTVTVSS

SEQ ID NO: 38 - protein, 107 aa, synthetic construct
  REGION 1..107: note = Artificial Sequence
SIQMTQSPSSLSASVGDRVTITCQASQSVRYNVAWYQQKPGKAPKLLIYYASNRYDGVPSRFSGSGSGTDFTFTISSLQPEDIATYFCQHHYSSPLTFGGGTKLEIK

SEQ ID NO: 39 - protein, 107 aa, synthetic construct
  REGION 1..107: note = Artificial Sequence
SIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 40 - protein, 30 aa, synthetic construct
  REGION 1..30: note = Artificial Sequence
QVQLVQSGSELKKPGASVKVSCKASGYTFT

SEQ ID NO: 41 - protein, 14 aa, synthetic construct
  REGION 1..14: note = Artificial Sequence
WVRQAPGQGLEWMG

SEQ ID NO: 42 - protein, 32 aa, synthetic construct
  REGION 1..32: note = Artificial Sequence
RFVFSADKSVSTAYLQISSLKAEDTAVYYCAR

SEQ ID NO: 43 - protein, 11 aa, synthetic construct
  REGION 1..11: note = Artificial Sequence
WGQGTTVTVSS

SEQ ID NO: 44 - protein, 23 aa, synthetic construct
  REGION 1..23: note = Artificial Sequence
SIQMTQSPSSLSASVGDRVTITC

SEQ ID NO: 45 - protein, 15 aa, synthetic construct
  REGION 1..15: note = Artificial Sequence
WYQQKPGKAPKLLIY

SEQ ID NO: 46 - protein, 32 aa, synthetic construct
  REGION 1..32: note = Artificial Sequence
GVPSRFSGSGSGTDFTFTISSLQPEDIATYFC

SEQ ID NO: 47 - protein, 10 aa, synthetic construct
  REGION 1..10: note = Artificial Sequence
FGGGTKLEIK

SEQ ID NO: 48 - protein, 30 aa, synthetic construct; identical to SEQ ID NO: 40
  REGION 1..30: note = Artificial Sequence

SEQ ID NO: 49 - protein, 14 aa, synthetic construct
  REGION 1..14: note = Artificial Sequence
WVRQAPGQGLEWMG

SEQ ID NO: 50 - protein, 32 aa, synthetic construct; identical to SEQ ID NO: 42
  REGION 1..32: note = Artificial Sequence

SEQ ID NO: 51 - protein, 11 aa, synthetic construct
  REGION 1..11: note = Artificial Sequence
WGQGTTVTVSS

SEQ ID NO: 52 - protein, 23 aa, synthetic construct
  REGION 1..23: note = Artificial Sequence
SIQMTQSPSSLSASVGDRVTITC

SEQ ID NO: 53 - protein, 15 aa, synthetic construct
  REGION 1..15: note = Artificial Sequence
WYQQKPGKAPKLLIY

SEQ ID NO: 54 - protein, 32 aa, synthetic construct; identical to SEQ ID NO: 46
  REGION 1..32: note = Artificial Sequence

SEQ ID NO: 55 - protein, 10 aa, synthetic construct
  REGION 1..10: note = Artificial Sequence
FGGGTKLEIK

SEQ ID NO: 56 - protein, 330 aa, synthetic construct
  REGION 1..330: note = Artificial Sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 107 aa, synthetic construct [sequence omitted]

SEQ ID NO: 58 - protein, 450 aa, synthetic construct
  REGION 1..450: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGGRYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 214 aa, synthetic construct
  REGION 1..214: note = Artificial Sequence
SIQMTQSPSSLSASVGDRVTITCQASQSVRYNVAWYQQKPGKAPKLLIYYASNRYDGVPSRFSGSGSGTDFTFTISSLQPEDIATYFCQHHYSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 450 aa, synthetic construct
  REGION 1..450: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPSRYTMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 214 aa, synthetic construct
  REGION 1..214: note = Artificial Sequence
SIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 63 - protein, 365 aa, Homo sapiens
MLLLLIPAHSSVLENEFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 64 - protein, 290 aa, Homo sapiens
QCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRNRDTMMSLLKTVVIVLGAFIICWTPGLVLLLLDVCCPQCDVLAYEKFFLLLAEFNSAMNPIIYSYRDKEMSATFRQILG

SEQ ID NO: 65 - protein, 15 aa, synthetic construct
  REGION 1..15: note = Artificial Sequence
IAFFYNRSGKHLATE

SEQ ID NO: 66 - protein, 15 aa, synthetic construct
  REGION 1..15: note = Artificial Sequence
MFNTGPNTRRLTVST

SEQ ID NO: 67 - protein, 15 aa, synthetic construct
  REGION 1..15: note = Artificial Sequence
CDIENCSNMAPLYSD

SEQ ID NO: 68 - protein, 15 aa, synthetic construct
  REGION 1..15: note = Artificial Sequence
LDVCCPQCDVLAYEK

SEQ ID NO: 69 - protein, 5 aa, synthetic construct
  REGION 1..5: note = Artificial Sequence
  VARIANT 1..5: note = Said residues may be present 1 to 8 times
GGGGS

SEQ ID NO: 70 - protein, 120 aa, synthetic construct
  REGION 1..120: note = Artificial Sequence
  VARIANT 30: note = X is selected from the group consisting of T, S, Y, D, E, G, N, R and K
  VARIANT 31: note = X is selected from the group consisting of S, A, G, H, I, K, L, M, N, P, Q, R, T, V, W, Y, D, E and F
  VARIANT 32: note = X is selected from the group consisting of S, A, Y, D, E, F, G, H, I, K, L, M, N, P, Q, R, T, V and W
  VARIANT 33: note = X is selected from the group consisting of G and A
  VARIANT 34: note = X is selected from the group consisting of I and M
  VARIANT 35: note = X is selected from the group consisting of S, A, N, D, E, F, G, H, I, K, L, M, P, Q, R, Y, T, V and W
  VARIANT 48: note = X is selected from the group consisting of I and M
  VARIANT 50: note = X is selected from the group consisting of E and W
  VARIANT 52: note = X is selected from the group consisting of L, D, G and N
  VARIANT 53: note = X is selected from the group consisting of P, A, D, F, G, N, Q, S, T, W and Y
  VARIANT 54: note = X is selected from the group consisting of R, W, D, Q, K, N, A, E, G, H, I, S, T, W, Y and L
  VARIANT 55: note = X is selected from the group consisting of S, D and T
  VARIANT 56: note = X is selected from the group consisting of G, A, D, E, N, R, S, T, W and Y
  VARIANT 57: note = X is selected from the group consisting of Y, D, E and N
  VARIANT 58: note = X is selected from the group consisting of T and P
  VARIANT 59: note = X is selected from the group consisting of N, D, E and T
  VARIANT 61: note = X is selected from the group consisting of N, R, W, Y, F, G, H, I, K, L, M, P, Q, S, T, V, D and E
  VARIANT 62: note = X is selected from the group consisting of E, G, A, R, H, K, D, S, T, N, Q, P, I, L, M, W, Y and V
  VARIANT 63: note = X is selected from the group consisting of G, D, E, H, L, M, P, R, V, Y, A, F, I, K, N, Q, S, T and W
  VARIANT 65: note = X is selected from the group consisting of T, Q, K, E, R and M
  VARIANT 70: note = X is selected from the group consisting of F and L
  VARIANT 76: note = X is selected from the group consisting of V and S
  VARIANT 95: note = X is selected from the group consisting of Y and F
  VARIANT 100: note = X is selected from the group consisting of F, A, I, K, L, N, P, Q, R, T, V, W, Y, D, E, G, H, M and S
  VARIANT 101: note = X is selected from the group consisting of G, A, R, H, K, D, E, S, T, N, Q, P, I, L, M, F, W, Y and V
  VARIANT 102: note = X is selected from the group consisting of R, H, K, D, E, S, T, N, Q, P, I, L, M, F, W, Y, V, A and G
  VARIANT 103: note = X is selected from the group consisting of S, A, R, H, K, D, T, N, Q, P, I, L, M, F, W, Y, V, E and G
  VARIANT 104: note = X is selected from the group consisting of R, S, Y, F, H, I, M, P, A, E, G, K, L, N, Q, T, V and W
  VARIANT 105: note = X is selected from the group consisting of Y, D, E, G, H, I, L, M, P, Q, S, V, W, A, F, K, N, R and T
  VARIANT 106: note = X is selected from the group consisting of A, S, T, E and D
  VARIANT 107: note = X is selected from the group consisting of M and L
  VARIANT 111: note = X is selected from the group consisting of G and S
QVQLVQSGSELKKPGASVKVSCKASGYTFXXXXXXWVRQAPGQGLEWXGXIXXXXXXXXYXXXFXGRFVXSADKSXSTAYLQISSLKAEDTAVYXCARDXXXXXXXXDYWXQGTTVTVSS

SEQ ID NO: 71 - protein, 107 aa, synthetic construct
  REGION 1..107: note = Artificial Sequence
  VARIANT 1: note = X is selected from the group consisting of S, D, Q, A, E and N
  VARIANT 24: note = X is selected from the group consisting of Q, G, K, R, S and T
  VARIANT 25: note = X is selected from the group consisting of A, G, L, R, S and T
  VARIANT 26: note = X is selected from the group consisting of S, A, D, G, N and T
  VARIANT 27: note = X is selected from the group consisting of Q, A, D, E, F, G, L, M, P, R, W, Y, S, T, V, N, H, I and K
  VARIANT 28: note = X is selected from the group consisting of S, A, D, G, H, I, L, N, T, V and Y
  VARIANT 29: note = X is selected from the group consisting of V, A, I, D, G, N, P, Q, R, S and T
  VARIANT 30: note = X is selected from the group consisting of R, A, S, D, G, I, K, N, S, T, V and Y
  VARIANT 31: note = X is selected from the group consisting of Y, A, N, D, F, G, I, K, L, M, P, Q, S, V, W, E, Hand T
  VARIANT 32: note = X is selected from the group consisting of N, A, Y, D, F, G, H, L, Q, S, T, W and R
  VARIANT 33: note = X is selected from the group consisting of V, A, L, I, K, M, P and Y
  VARIANT 34: note = X is selected from the group consisting of A, N, D, E, G, H, N, Q, S, T and Y
  VARIANT 50: note = X is selected from the group consisting of Y, A, D, I, K, L, M, N, P, Q, R, S, T, V, W, E, F, H and G
  VARIANT 52: note = X is selected from the group consisting of S, A, E, V, Y, D, F, G, H, I, K, L, M, N, P, Q, R, T and W
  VARIANT 53: note = X is selected from the group consisting of N, A, D, E, K, Q, R, S, T and Y
  VARIANT 54: note = X is selected from the group consisting of R, A, L, G, K and S
  VARIANT 55: note = X is selected from the group consisting of Y, A, E, D, F, G, H, I, K, L, M, N, P, Q, R, S, T, V and W
  VARIANT 56: note = X is selected from the group consisting of T, A, Q, R, V, W, Y, F, S, D, E, G, H, I, K, L, M, N and P
  VARIANT 87: note = X is selected from the group consisting of F and Y
  VARIANT 89: note = X is selected from the group consisting of Q, A, S and L
  VARIANT 90: note = X is selected from the group consisting of Q, A, G, L, N, S, T, V and H
  VARIANT 91: note = X is selected from the group consisting of H, A, Y, D, F, G, L, R, S, T, W and Y
  VARIANT 92: note = X is selected from the group consisting of Y, A, D and L
  VARIANT 93: note = X is selected from the group consisting of N, R, H, K, D, E, T, Q, P, I, L, M, F, W, Y, V, A, G and S
  VARIANT 94: note = X is selected from the group consisting of S, A, L, D, F, G, I, N, R, T, V, W and Y
  VARIANT 95: note = X is selected from the group consisting of P and A
  VARIANT 96: note = X is selected from the group consisting of L, A and E
  VARIANT 97: note = X is selected from the group consisting of T, A and Y
XIQMTQSPSSLSASVGDRVTITCXXXXXXXXXXXWYQQKPGKAPKLLIYXAXXXXXGVPSRFSGSGSGTDFTFTISSLQPEDIATYXCXXXXXXXXXFGGGTKLEIK

SEQ ID NO: 72-75 - skipped (4 entries)

SEQ ID NO: 76 - protein, 17 aa, synthetic construct
  REGION 1..17: note = Artificial Sequence
  VARIANT 1: note = X is selected from the group consisting of E
  VARIANT 3: note = X is selected from the group consisting of L, Q and D
  VARIANT 4: note = X is selected from the group consisting of P, A, G, F, S, T and W
  VARIANT 5: note = X is selected from the group consisting of R
  VARIANT 6: note = X is selected from the group consisting of S, T and D
  VARIANT 7: note = X is selected from the group consisting of G, R, S, Y, A, T, D, E and W
  VARIANT 8: note = X is selected from the group consisting of Y
  VARIANT 9: note = X is selected from the group consisting of T
  VARIANT 10: note = X is selected from the group consisting of N, H and S
  VARIANT 12: note = X is selected from the group consisting of R, N, F, K, Q, V, D, E, Y, G, M, P, W, H, L, I, S, T and A
  VARIANT 13: note = X is selected from the group consisting of Q, A, I, S, P, T, N, V, G, H, L, M, W, K, R, F, D, Y and E
  VARIANT 14: note = X is selected from the group consisting of G, D, E, H, L, V, Y, A, F, I, K, Q, W, R, M, P, S and N
  VARIANT 16: note = X is selected from the group consisting of T, K, Q, E, R and M
XIXXXXXXXXYXXXFXG

SEQ ID NO: 77 - protein, 17 aa, synthetic construct
  REGION 1..17: note = Artificial Sequence
  VARIANT 1: note = X is selected from the group consisting of E
  VARIANT 3: note = X is selected from the group consisting of L and Q
  VARIANT 4: note = X is selected from the group consisting of P, A, G, F, S and T
  VARIANT 5: note = X is selected from the group consisting of R
  VARIANT 6: note = X is selected from the group consisting of S, T and D
  VARIANT 7: note = X is selected from the group consisting of G, R, S, Y, A, T, D, E and W
  VARIANT 8: note = X is selected from the group consisting of Y
  VARIANT 9: note = X is selected from the group consisting of T
  VARIANT 10: note = X is selected from the group consisting of N, H and S
  VARIANT 12: note = X is selected from the group consisting of R, N, F, K, Q, V, D, E, Y, G, M, P, W, H and L
  VARIANT 13: note = X is selected from the group consisting of Q, A, I, S, P, T, N, V, G, H, L, M, W, K, R, F, D, Y and E
  VARIANT 14: note = X is selected from the group consisting of G, D, E, H, L, V, Y, A, F, I, K, Q, W, R, M, P and S
  VARIANT 16: note = X is selected from the group consisting of T, K, Q, E, R and M
XIXXXXXXXXYXXXFXG

SEQ ID NO: 78 - protein, 17 aa, synthetic construct
  REGION 1..17: note = Artificial Sequence
  VARIANT 1: note = X is selected from the group consisting of E
  VARIANT 3: note = X is selected from the group consisting of L and Q
  VARIANT 4: note = X is selected from the group consisting of P, A, G, Fand S
  VARIANT 5: note = X is selected from the group consisting of R
  VARIANT 6: note = X is selected from the group consisting of S and T
  VARIANT 7: note = X is selected from the group consisting of G, R, S, Y, A and T
  VARIANT 8: note = X is selected from the group consisting of Y
  VARIANT 9: note = X is selected from the group consisting of T
  VARIANT 10: note = X is selected from the group consisting of N, H and S
  VARIANT 12: note = X is selected from the group consisting of R, N, F, K, Q, V, D, E, Y, G, M and P
  VARIANT 13: note = X is selected from the group consisting of Q, A, I, S, P, T, N, V, G, H, L, M, W, K, R and F
  VARIANT 14: note = X is selected from the group consisting of G, D, E, H, L, V, Y, A, F, I, K, Q, W, R, M, P andS
  VARIANT 16: note = X is selected from the group consisting of T, K, Q, E, R and M
XIXXXXXXXXYXXXFXG

SEQ ID NO: 79 - protein, 17 aa, synthetic construct
  REGION 1..17: note = Artificial Sequence
  VARIANT 1: note = X is selected from the group consisting of E
  VARIANT 3: note = X is selected from the group consisting of L and Q
  VARIANT 4: note = X is selected from the group consisting of P, A and G
  VARIANT 5: note = X is selected from the group consisting of R
  VARIANT 6: note = X is selected from the group consisting of S and T
  VARIANT 7: note = X is selected from the group consisting of G and R
  VARIANT 8: note = X is selected from the group consisting of Y
  VARIANT 9: note = X is selected from the group consisting of T
  VARIANT 10: note = X is selected from the group consisting of N, H and S
  VARIANT 12: note = X is selected from the group consisting of R, N, F, K, Q, V, D and E
  VARIANT 13: note = X is selected from the group consisting of Q, A, I, S, P, T, N and V
  VARIANT 14: note = X is selected from the group consisting of G, D, E, H, L, V, Y, A, F, I, K, Q, W and R
  VARIANT 16: note = X is selected from the group consisting of T and K
XIXXXXXXXXYXXXFXG

SEQ ID NO: 80-95 - skipped (16 entries)

SEQ ID NO: 96 - protein, 120 aa, synthetic construct
  REGION 1..120: note = Artificial Sequence
QVQLVQSGSELKKPGASVKVSCKASGYTFTSSGISWVRQAPGQGLEWIGEILPRSGYTNYNEGFTGRFVLSADKSSSTAYLQISSLKAEDTAVYFCARDFGSSRYAMDYWGQGTTVTVSS

SEQ ID NO: 97 - protein, 107 aa, synthetic construct; identical to SEQ ID NO: 34
  REGION 1..107: note = Artificial Sequence

SEQ ID NO: 98 - protein, 7 aa, synthetic construct
  REGION 1..7: note = Artificial Sequence
YASNRYE

SEQ ID NO: 99 - protein, 107 aa, synthetic construct
  REGION 1..107: note = Artificial Sequence
SIQMTQSPSSLSASVGDRVTITCQASQSVRYNVAWYQQKPGKAPKLLIYYASNRYEGVPSRFSGSGSGTDFTFTISSLQPEDIATYFCQHHYSSPLTFGGGTKLEIK

SEQ ID NO: 100 - protein, 17 aa, synthetic construct
  REGION 1..17: note = Artificial Sequence
EIQPRSGYTNYNQGFTG

SEQ ID NO: 101 - protein, 11 aa, synthetic construct
  REGION 1..11: note = Artificial Sequence
DKGPARYTMDY

SEQ ID NO: 102 - protein, 120 aa, synthetic construct
  REGION 1..120: note = Artificial Sequence
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDKGPARYTMDYWGQGTTVTVSS

SEQ ID NO: 103 - protein, 11 aa, synthetic construct
  REGION 1..11: note = Artificial Sequence
QASQSIRYNVA

SEQ ID NO: 104 - protein, 107 aa, synthetic construct
  REGION 1..107: note = Artificial Sequence
SIQMTQSPSSLSASVGDRVTITCQASQSIRYNVAWYQQKPGKAPKLLIYYASNRYEGVPSRFSGSGSGTDFTFTISSLQPEDIATYYCQHHYSSPLTFGGGTKLEIK

SEQ ID NO: 105 - protein, 120 aa, synthetic construct; identical to SEQ ID NO: 29
  REGION 1..120: note = Artificial Sequence

SEQ ID NO: 106 - protein, 107 aa, synthetic construct; identical to SEQ ID NO: 30
  REGION 1..107: note = Artificial Sequence

SEQ ID NO: 107 - protein, 5 aa, synthetic construct
  REGION 1..5: note = Artificial Sequence
RYWMS

SEQ ID NO: 108 - protein, 17 aa, synthetic construct
  REGION 1..17: note = Artificial Sequence
EINPSRSAINYSPSLKD

SEQ ID NO: 109 - protein, 11 aa, synthetic construct
  REGION 1..11: note = Artificial Sequence
QGQRLRYGMDY

SEQ ID NO: 110 - protein, 11 aa, synthetic construct
  REGION 1..11: note = Artificial Sequence
RASQDVRTAVA

SEQ ID NO: 111 - protein, 7 aa, synthetic construct
  REGION 1..7: note = Artificial Sequence
WTSTRHT

SEQ ID NO: 112 - protein, 9 aa, synthetic construct
  REGION 1..9: note = Artificial Sequence
QQHYGTPLT

SEQ ID NO: 113 - protein, 120 aa, synthetic construct
  REGION 1..120: note = Artificial Sequence
EVKLLESGGGLVQPGGSLKLSCTASGFDFSRYWMSWVRQAPGKGLEWIGEINPSRSAINYSPSLKDKFIISRDNAKNTLYLQMSKVRSEDTALYYCARQGQRLRYGMDYWGQGTSVTVSS

SEQ ID NO: 114 - protein, 107 aa, synthetic construct
  REGION 1..107: note = Artificial Sequence
DIVMTQSPNFMSTSVGDRVSVTCRASQDVRTAVAWYQQKPGRSPKLLIYWTSTRHTGVPDRFTGSGSGTDYTLTISSVQAADLALYYCQQHYGTPLTFGAGTNLELK

SEQ ID NO: 115 - protein, 107 aa, synthetic construct
  REGION 1..107: note = >Tgex 207B7 Hu-VL3-germ-IGKV1-33*01
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 116 - protein, 107 aa, synthetic construct
  REGION 1..107: note = >HuVL4_H90S93_Y87F
DIQMTQSPSSLSASVGDRVTITCQASQSVRYNVAWYQQKPGKAPKLLIYYASNLYTGVPSRFSGSGSGTDFTFTISSLQPEDIATYFCQHHYSSPLTFGGGTKLEIK

SEQ ID NO: 117 - protein, 107 aa, synthetic construct
  REGION 1..107: note = >HuVL3_H90S93_S1D
DIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 118 - protein, 107 aa, synthetic construct
  REGION 1..107: note = >HuVL4_H90S93_L54R
DIQMTQSPSSLSASVGDRVTITCQASQSVRYNVAWYQQKPGKAPKLLIYYASNRYTGVPSRFSGSGSGTDFTFTISSLQPEDIATYYCQHHYSSPLTFGGGTKLEIK

SEQ ID NO: 119 - protein, 107 aa, synthetic construct
  REGION 1..107: note = >63D8_HuVL2_v2
DIQMTQSPSSLSASVGDRVTITCRASQDVRTAVAWYQQKPGKAPKLLIYWTSTLHSGVPSRFSGSGSGTDYTLTISSLQPEDFATYYCQQHYGTPLTFGGGTKLEIK

SEQ ID NO: 120 - protein, 107 aa, synthetic construct
  REGION 1..107: note = Artificial Sequence
DIQMTQSPSSLSASVGDRVTITCRASQDVRTAVAWYQQKPGKAPKLLIYWTSTRHTGVPSRFSGSGSGTDYTLTISSLQPEDFATYYCQQHYGTPLTFGGGTNLEIK

SEQ ID NO: 121 - protein, 107 aa, synthetic construct
  REGION 1..107: note = >63D8_HuVL4_v2
DIVMTQSPDSLAVSLGERATINCKASQDVRTAVAWYQQKPGQPPKLLIYWTSTRHSGVPDRFSGSGSGTDYTLTISSLQAEDVAVYYCQQHYGTPLTFGGGTKLEIK

SEQ ID NO: 122 - protein, 107 aa, synthetic construct
  REGION 1..107: note = >63D8_HuVL3_v2
DIVMTQSPDSLAVSLGERATINCKASQDVRTAVAWYQQKPGQPPKLLIYWTSTRHTGVPDRFSGSGSGTDYTLTISSLQAEDVAVYYCQQHYGTPLTFGGGTNLEIK

SEQ ID NO: 123 - protein, 107 aa, synthetic construct; identical to SEQ ID NO: 114
  REGION 1..107: note = >TGEX-LC Human Kappa 63D8

SEQ ID NO: 124 - protein, 120 aa, synthetic construct; identical to SEQ ID NO: 113
  REGION 1..120: note = >TGEX-HC Human IgG1 repurified 63D8

SEQ ID NO: 125 - protein, 120 aa, synthetic construct
  REGION 1..120: note = >Tgex 63D8_HuVH3-sil
EVKLQESGPGLVKPSGTLSLTCAASGFDFSRYWMSWVWVRQPPGKGWIGEINPSRSAINYSPSLKSRVTISRDNSKNTLSLKLSSVTAADTAVYYCARQGQRLRYGMDYWGQGTTVTVSS

SEQ ID NO: 126 - protein, 120 aa, synthetic construct
  REGION 1..120: note = >Tgex 63D8_HuVH1-sil
EVKLVESGGGLVQPGGSLRLSCAASGFDFSRYWMSWVRQAPGKGLEWIGEINPSRSAINYSPSVKGRFTISRDNAKNTLYLQMNSLRAEDTAVYYCARQGQRLRYGMDYWGQGTTVTVSS

SEQ ID NO: 127 - protein, 120 aa, synthetic construct
  REGION 1..120: note = >Tgex 63D8_HuVH2-sil
EVQLVESGGGLVQPGGSLRLSCAASGFDFSRYWMSWVRQAPGKGLEWVGEINPSRSAINYSPSVKGRFTISRDNAKNSLYLQMNSLRAEDTAVYYCARQGQRLRYGMDYWGQGTTVTVSS

SEQ ID NO: 128 - protein, 107 aa, synthetic construct
  REGION 1..107: note = >Hu-VL3_Q1G55H90S93
QIQMTQSPSSLSASVGDRVTITCQASQSVRYNVAWYQQKPGKAPKLLIYYASNRGTGVPSRFSGSGSGTDFTFTISSLQPEDIATYFCQHHYSSPLTFGGGTKLEIK

SEQ ID NO: 129 - protein, 120 aa, synthetic construct
  REGION 1..120: note = >Tgex 63D8_HuVH4-sil (LALA_P331S)
QVQLQESGPGLVKPSGTLSLTCAASGFDFSRYWNWWSWVRQPPGKGWEGEINPSRSAINYSPSLKSRVTISRDNSKNQLSLKLSSVTAADTAVYYCARQGQRLRYGMDYWGQGTTVTVSS

SEQ ID NO: 130 - protein, 120 aa, synthetic construct; identical to SEQ ID NO: 23
  REGION 1..120: note = >TGEX-HC Human IgG1 207B7 (LPAR1)

SEQ ID NO: 131 - protein, 120 aa, synthetic construct
  REGION 1..120: note = >TGEX-HC Human IgG1 207B7 germline 207B7169A1 CDRs
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFDNSRYALDYWGQGTSVTVSS

SEQ ID NO: 132 - protein, 120 aa, synthetic construct; identical to SEQ ID NO: 27
  REGION 1..120: note = >TGEX-HC Human IgG1 207B7 germline 207B7 CDRs

SEQ ID NO: 133 - protein, 120 aa, synthetic construct; identical to SEQ ID NO: 29
  REGION 1..120: note = >TGEX-HC Human IgG1 169A1

SEQ ID NO: 134 - protein, 120 aa, synthetic construct
  REGION 1..120: note = >TGEX-HC Human IgG1 207B7 169A1 LCA
QVQLQQSGAELARPGASVKLSCKASGYTFTSSGISWVKQRTGQGLEWIGEIYPRSGYTNYNEKFKGKASLTADKSSSTAYMELRSLTSEDSAVYFCARDYGSSRYAMDYWGQGTSVTVSS

SEQ ID NO: 135 - protein, 120 aa, synthetic construct
  REGION 1..120: note = >TGEX-HC Human IgG1 207B7 germline 169A1 CDRs
QVQLQQSGAELARPGASVKLSCKASGYTFTSSGISWVKQRTGQGLEWIGEIYPRSGYTNYNEKFKGKATLTADKSSSTAYMELRSLTSEDSAVYFCARDYDNSRYALDYWGQGTSVTVSS

SEQ ID NO: 136 - protein, 120 aa, synthetic construct
  REGION 1..120: note = >TGEX-HC Human IgG1 207B7 germline LCA CDRs
QVQLQQSGAELARPGASVKLSCKASGYTFTSSGISWVKQRTGQGLEWIGEIYPRSGYTNYNEKFKGKATLTADKSSSTAYMELRSLTSEDSAVYFCARDYGSSRYAMDYWGQGTSVTVSS

SEQ ID NO: 137 - protein, 120 aa, synthetic construct; identical to SEQ ID NO: 25
  REGION 1..120: note = >TGEX-HC Human IgG1 207B7 germline

SEQ ID NO: 138 - protein, 120 aa, synthetic construct
  REGION 1..120: note = >huVH4_D30Q61K97G99 Fab
QVQLVQSGSELKKPGASVKVSCKASGYTFDSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 139 - protein, 120 aa, synthetic construct
  REGION 1..120: note = >Tgex 207B7 huVH4_E30K31Q61K97G99 IgG1
QVQLVQSGSELKKPGASVKVSCKASGYTFEKSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 140 - protein, 120 aa, synthetic construct
  REGION 1..120: note = >Tgex 207B7 huVH4_E30Q61A97A99 IgG1
QVQLVQSGSELKKPGASVKVSCKASGYTFESSGISWVRQAPGQGLEWMGEILPRSGYTNYNQGFTGRFVFSADKSVSTAYLQISSLKAEDTAVYYCARDFASARYAMDYWGQGTTVTVSS

SEQ ID NO: 141 - protein, 120 aa, synthetic construct
  REGION 1..120: note = >Tgex huVH4_E30Q61K97G98G99 sil (LALA_P331S)
QVQLVQSGSELKKPGASVKVSCKASGYTFESSGISWVRQAPGQGLEWMGEILPRSGYTNYNQGFTGRFVFSADKSVSTAYLQISSLKAEDTAVYYCARDFKGGRYAMDYWGQGTTVTVSS

SEQ ID NO: 142 - protein, 120 aa, synthetic construct
  REGION 1..120: note = >huVH4_E30Q61K97G99 Fab
QVQLVQSGSELKKPGASVKVSCKASGYTFESSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 143 - protein, 120 aa, synthetic construct
  REGION 1..120: note = >Tgex huVH4_E30Q61R97G98G99 sil (LALA_P331S)
QVQLVQSGSELKKPGASVKVSCKASGYTFESSGISWVRQAPGQGLEWMGEILPRSGYTNYNQGFTGRFVFSADKSVSTAYLQISSLKAEDTAVYYCARDFRGGRYAMDYWGQGTTVTVSS

SEQ ID NO: 144 - protein, 120 aa, synthetic construct
  REGION 1..120: note = >Tgex huVH4_E30Q61-CDRH3-43sil (LALA_P331S)
QVQLVQSGSELKKPGASVKVSCKASGYTFESSGISWVRQAPGQGLEWMGEILPRSGYTNYNQGFTGRFVFSADKSVSTAYLQISSLKAEDTAVYYCARDKGPSRYTMDYWGQGTTVTVSS

SEQ ID NO: 145 - protein, 120 aa, synthetic construct
  REGION 1..120: note = >huVH4_G30Q61K97G99 Fab
QVQLVQSGSELKKPGASVKVSCKASGYTFGSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 146 - protein, 120 aa, synthetic construct
  REGION 1..120: note = >huVH4_K30Q61K97G99 Fab
QVQLVQSGSELKKPGASVKVSCKASGYTFKSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 147 - protein, 120 aa, synthetic construct
  REGION 1..120: note = >huVH4_N30Q61K97G99 Fab
QVQLVQSGSELKKPGASVKVSCKASGYTFNSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 148 - protein, 120 aa, synthetic construct
  REGION 1..120: note = >huVH4_R30Q61K97G99 Fab
QVQLVQSGSELKKPGASVKVSCKASGYTFRSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 149 - protein, 120 aa, synthetic construct
  REGION 1..120: note = >Tgex 207B7 huVH4_S30K60Q61A97A99 IgG1
QVQLVQSGSELKKPGASVKVSCKASGYTFSSSGISWVRQAPGQGLEWMGEILPRSGYTNYKQGFTGRFVFSADKSVSTAYLQISSLKAEDTAVYYCARDFASARYAMDYWGQGTTVTVSS

SEQ ID NO: 150 - protein, 120 aa, synthetic construct
  REGION 1..120: note = >Tgex 207B7 huVH4_S30K60Q61K97G99 IgG1
QVQLVQSGSELKKPGASVKVSCKASGYTFSSSGISWVRQAPGQGLEWMGEILPRSGYTNYKQGFTGRFVFSADKSVSTAYLQISSLKAEDTAVYYCARDFKSGRYAMDYWGQGTTVTVSS

SEQ ID NO: 151 - protein, 120 aa, synthetic construct
  REGION 1..120: note = >Tgex 207B7 huVH4_S30K60Q61K62E64A97A99 IgG1
QVQLVQSGSELKKPGASVKVSCKASGYTFSSSGISWVRQAPGQGLEWMGEILPRSGYTNYKQKFEGRFVFSADKSVSTAYLQISSLKAEDTAVYYCARDFASARYAMDYWGQGTTVTVSS

SEQ ID NO: 152 - protein, 120 aa, synthetic construct
  REGION 1..120: note = >Tgex 207B7 huVH4_S30K60Q61K62E64K97G99 IgG1
QVQLVQSGSELKKPGASVKVSCKASGYTFSSSGISWVRQAPGQGLEWMGEILPRSGYTNYKQKFEGRFVFSADKSVSTAYLQISSLKAEDTAVYYCARDFKSGRYAMDYWGQGTTVTVSS

SEQ ID NO: 153 - protein, 120 aa, synthetic construct
  REGION 1..120: note = >Tgex 207B7 huVH4_S30Q61A97A99 IgG1
QVQLVQSGSELKKPGASVKVSCKASGYTFSSSGISWVRQAPGQGLEWMGEILPRSGYTNYNQGFTGRFVFSADKSVSTAYLQISSLKAEDTAVYYCARDFASARYAMDYWGQGTTVTVSS

SEQ ID NO: 154 - protein, 120 aa, synthetic construct
  REGION 1..120: note = >huVH4_S30Q61K97G99 Fab
QVQLVQSGSELKKPGASVKVSCKASGYTFSSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 155 - protein, 120 aa, synthetic construct
  REGION 1..120: note = >Tgex 207B7 huVH4_S30Q61K62E64A97A99 IgG1
QVQLVQSGSELKKPGASVKVSCKASGYTFSSSGISWVRQAPGQGLEWMGEILPRSGYTNYNQKFEGRFVFSADKSVSTAYLQISSLKAEDTAVYYCARDFASARYAMDYWGQGTTVTVSS

SEQ ID NO: 156 - protein, 120 aa, synthetic construct
  REGION 1..120: note = >Tgex 207B7 huVH4_S30Q61K62E64K97G99 IgG1
QVQLVQSGSELKKPGASVKVSCKASGYTFSSSGISWVRQAPGQGLEWMGEILPRSGYTNYNQKFEGRFVFSADKSVSTAYLQISSLKAEDTAVYYCARDFKSGRYAMDYWGQGTTVTVSS

SEQ ID NO: 157 - protein, 120 aa, synthetic construct
  REGION 1..120: note = >Tgex 207B7 huVH4_S30Q61K62A97A99 IgG1
QVQLVQSGSELKKPGASVKVSCKASGYTFSSSGISWVRQAPGQGLEWMGEILPRSGYTNYNQKFTGRFVFSADKSVSTAYLQISSLKAEDTAVYYCARDFASARYAMDYWGQGTTVTVSS

SEQ ID NO: 158 - protein, 120 aa, synthetic construct
  REGION 1..120: note = >Tgex 207B7 huVH4_S30Q61K62K97G99 IgG1
QVQLVQSGSELKKPGASVKVSCKASGYTFSSSGISWVRQAPGQGLEWMGEILPRSGYTNYNQKFTGRFVFSADKSVSTAYLQISSLKAEDTAVYYCARDFKSGRYAMDYWGQGTTVTVSS

SEQ ID NO: 159 - protein, 120 aa, synthetic construct
  REGION 1..120: note = >HuVH4-QRGG_A31
QVQLVQSGSELKKPGASVKVSCKASGYTFTASGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 160 - protein, 120 aa, synthetic construct
  REGION 1..120: note = >Tgex 207B7 huVH4_K31Q61A97A99 IgG1
QVQLVQSGSELKKPGASVKVSCKASGYTFTKSGISWVRQAPGQGLEWMGEILPRSGYTNYNQGFTGRFVFSADKSVSTAYLQISSLKAEDTAVYYCARDFASARYAMDYWGQGTTVTVSS

SEQ ID NO: 161 - protein, 120 aa, synthetic construct
  REGION 1..120: note = >Tgex 207B7 huVH4_K31Q61K97G99 IgG1
QVQLVQSGSELKKPGASVKVSCKASGYTFTKSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 162 - protein, 120 aa, synthetic construct
  REGION 1..120: note = >huVH4_R31D52Q61K97G99 IgG
QVQLVQSGSELKKPGASVKVSCKASGYTFTRSGISWVRQAPGQGLEWMGEIDPRSGYTNYNQGFTGRFVFSADKSVSTAYLQISSLKAEDTAVYYCARDFKSGRYAMDYWGQGTTVTVSS

SEQ ID NO: 163 - protein, 120 aa, synthetic construct
  REGION 1..120: note = >huVH4_R31D53Q61K97G99 IgG
QVQLVQSGSELKKPGASVKVSCKASGYTFTRSGISWVRQAPGQGLEWMGEILPDSGYTNYNQGFTGRFVFSADKSVSTAYLQISSLKAEDTAVYYCARDFKSGRYAMDYWGQGTTVTVSS

SEQ ID NO: 164 - protein, 120 aa, synthetic construct
  REGION 1..120: note = >huVH4_R31D54Q61K97G99 IgG
QVQLVQSGSELKKPGASVKVSCKASGYTFTRSGISWVRQAPGQGLEWMGEILPRDGYTNYNQGFTGRFVFSADKSVSTAYLQISSLKAEDTAVYYCARDFKSGRYAMDYWGQGTTVTVSS

SEQ ID NO: 165 - protein, 120 aa, synthetic construct
  REGION 1..120: note = >huVH4_R31D56Q61K97G99 IgG
QVQLVQSGSELKKPGASVKVSCKASGYTFTRSGISWVRQAPGQGLEWMGEILPRSGDTNYNQGFTGRFVFSADKSVSTAYLQISSLKAEDTAVYYCARDFKSGRYAMDYWGQGTTVTVSS

SEQ ID NO: 166 - protein, 120 aa, synthetic construct
  REGION 1..120: note = >huVH4_R31E56Q61K97G99 IgG
QVQLVQSGSELKKPGASVKVSCKASGYTFTRSGISWVRQAPGQGLEWMGEILPRSGETNYNQGFTGRFVFSADKSVSTAYLQISSLKAEDTAVYYCARDFKSGRYAMDYWGQGTTVTVSS

SEQ ID NO: 167 - protein, 120 aa, synthetic construct
  REGION 1..120: note = >huVH4_R31D58Q61K97G99 IgG
QVQLVQSGSELKKPGASVKVSCKASGYTFTRSGISWVRQAPGQGLEWMGEILPRSGYTDYNQGFTGRFVFSADKSVSTAYLQISSLKAEDTAVYYCARDFKSGRYAMDYWGQGTTVTVSS

SEQ ID NO: 168 - protein, 120 aa, synthetic construct
  REGION 1..120: note = >huVH4_R31E58Q61K97G99 IgG
QVQLVQSGSELKKPGASVKVSCKASGYTFTRSGISWVRQAPGQGLEWMGEILPRSGYTEYNQGFTGRFVFSADKSVSTAYLQISSLKAEDTAVYYCARDFKSGRYAMDYWGQGTTVTVSS

SEQ ID NO: 169 - protein, 120 aa, synthetic construct
  REGION 1..120: note = >huVH4_R31Q61A62K97G99 IgG
QVQLVQSGSELKKPGASVKVSCKASGYTFTRSGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 170 - protein, 120 aa, synthetic construct
  REGION 1..120: note = >huVH4_R31Q61K97G99 IgG
QVQLVQSGSELKKPGASVKVSCKASGYTFTRSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 171 - protein, 120 aa, synthetic construct
  REGION 1..120: note = >huVH4_R31T32Q61K97G99 IgG
QVQLVQSGSELKKPGASVKVSCKASGYTFTRTGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 172 - protein, 120 aa, synthetic construct
  REGION 1..120: note = >HuVH4-QRGG_A32
QVQLVQSGSELKKPGASVKVSCKASGYTFTSAGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 173 - protein, 120 aa, synthetic construct
  REGION 1..120: note = >huVH4_H32Q35Q61A62K97G99 IgG
QVQLVQSGSELKKPGASVKVSCKASGYTFTSHGIQWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 174 - protein, 120 aa, synthetic construct
  REGION 1..120: note = >huVH4_H32Q35Q61K97G99 IgG
QVQLVQSGSELKKPGASVKVSCKASGYTFTSHGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 175 - protein, 120 aa, synthetic construct
  REGION 1..120: note = >huVH4_H32Q61A62K97G99 IgG
QVQLVQSGSELKKPGASVKVSCKASGYTFTSHGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 176 - protein, 120 aa, synthetic construct
  REGION 1..120: note = >huVH4_H32Q61K97G99 IgG
QVQLVQSGSELKKPGASVKVSCKASGYTFTSHGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 177 - protein, 120 aa, synthetic construct
  REGION 1..120: note = >huVH4_R32Q61A62K97G99 IgG
QVQLVQSGSELKKPGASVKVSCKASGYTFTSRGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 178 - protein, 120 aa, synthetic construct
  REGION 1..120: note = >huVH4_R32Q61K97G99 IgG
QVQLVQSGSELKKPGASVKVSCKASGYTFTSRGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 179 - protein, 120 aa, synthetic construct
  REGION 1..120: note = >HuVH4-QRGG_A33N35
QVQLVQSGSELKKPGASVKVSCKASGYTFTSSAINWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 180 - protein, 120 aa, synthetic construct
  REGION 1..120: note = >HuVH4-QRGG_A33
QVQLVQSGSELKKPGASVKVSCKASGYTFTSSAISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 181 - protein, 120 aa, synthetic construct
  REGION 1..120: note = >HuVH4-QRGG_A33M34N35
QVQLVQSGSELKKPGASVKVSCKASGYTFTSSAMNWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 182 - protein, 120 aa, synthetic construct
  REGION 1..120: note = >huVH4-QRGG_A35
QVQLVQSGSELKKPGASVKVSCKASGYTFTSSGIAWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 183 - protein, 120 aa, synthetic construct
  REGION 1..120: note = >huVH4_E35Q61K97G99 IgG
QVQLVQSGSELKKPGASVKVSCKASGYTFTSSGIEWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 184 - protein, 120 aa, synthetic construct
  REGION 1..120: note = >HuVH4-QRGG_N35
QVQLVQSGSELKKPGASVKVSCKASGYTFTSSGINWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 185 - protein, 120 aa, synthetic construct
  REGION 1..120: note = >huVH4_Q35Q61K97G99 IgG
QVQLVQSGSELKKPGASVKVSCKASGYTFTSSGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 186 - protein, 120 aa, synthetic construct
  REGION 1..120: note = >huVH3_E61G97G99G104
QVQLVQSGSELKKPGASVKVSCKASGYTFTSSGISWVRQAPGQGLEWIGEILPRSGYTNYNEGFTGRFVLSADKSSSTAYLQISSLKAEDTAVYFCARDFGSGRYAMDYWGQGTTVTVSS

SEQ ID NO: 187 - protein, 120 aa, synthetic construct
  REGION 1..120: note = >huVH3_E61R97G99G104
QVQLVQSGSELKKPGASVKVSCKASGYTFTSSGISWVRQAPGQGLEWIGEILPRSGYTNYNEGFTGRFVLSADKSSSTAYLQISSLKAEDTAVYFCARDFRSGRYAMDYWGQGTTVTVSS

SEQ ID NO: 188 - protein, 120 aa, synthetic construct
  REGION 1..120: note = >huVH3_E61R97S99G104
QVQLVQSGSELKKPGASVKVSCKASGYTFTSSGISWVRQAPGQGLEWIGEILPRSGYTNYNEGFTGRFVLSADKSSSTAYLQISSLKAEDTAVYFCARDFRSSRYAMDYWGQGTTVTVSS

SEQ ID NO: 189 - protein, 120 aa, synthetic construct
  REGION 1..120: note = >huVH4-QRGG_I48S75
QVQLVQSGSELKKPGASVKVSCKASGYTFTSSGISWVRQAPGQGLEWIGEILPRSGYTNYNQGFTGRFVFSADKSSSTAYLQISSLKAEDTAVYYCARDFRSGRYAMDYWGQGTTVTVSS

SEQ ID NO: 190 - protein, 120 aa, synthetic construct
  REGION 1..120: note = >huVH4-QRGG_I48F91
QVQLVQSGSELKKPGASVKVSCKASGYTFTSSGISWVRQAPGQGLEWIGEILPRSGYTNYNQGFTGRFVFSADKSVSTAYLQISSLKAEDTAVYFCARDFRSGRYAMDYWGQGTTVTVSS

SEQ ID NO: 191 - protein, 120 aa, synthetic construct
  REGION 1..120: note = >huVH4-QRGG_I48
QVQLVQSGSELKKPGASVKVSCKASGYTFTSSGISWVRQAPGQGLEWIGEILPRSGYTNYNQGFTGRFVFSADKSVSTAYLQISSLKAEDTAVYYCARDFRSGRYAMDYWGQGTTVTVSS

SEQ ID NO: 192 - protein, 120 aa, synthetic construct
  REGION 1..120: note = >huVH3_Q61G97G99G104
QVQLVQSGSELKKPGASVKVSCKASGYTFTSSGISWVRQAPGQGLEWIGEILPRSGYTNYNQGFTGRFVLSADKSSSTAYLQISSLKAEDTAVYFCARDFGSGRYAMDYWGQGTTVTVSS

SEQ ID NO: 193 - protein, 120 aa, synthetic construct
  REGION 1..120: note = >huVH3_Q61G97S99G104
QVQLVQSGSELKKPGASVKVSCKASGYTFTSSGISWVRQAPGQGLEWIGEILPRSGYTNYNQGFTGRFVLSADKSSSTAYLQISSLKAEDTAVYFCARDFGSSRYAMDYWGQGTTVTVSS

SEQ ID NO: 194 - protein, 120 aa, synthetic construct
  REGION 1..120: note = >huVH3_Q61R97G99G104
QVQLVQSGSELKKPGASVKVSCKASGYTFTSSGISWVRQAPGQGLEWIGEILPRSGYTNYNQGFTGRFVLSADKSSSTAYLQISSLKAEDTAVYFCARDFRSGRYAMDYWGQGTTVTVSS

SEQ ID NO: 195 - protein, 120 aa, synthetic construct
  REGION 1..120: note = >huVH3_Q61R97S99G104
QVQLVQSGSELKKPGASVKVSCKASGYTFTSSGISWVRQAPGQGLEWIGEILPRSGYTNYNQGFTGRFVLSADKSSSTAYLQISSLKAEDTAVYFCARDFRSSRYAMDYWGQGTTVTVSS

SEQ ID NO: 196 - protein, 120 aa, synthetic construct
  REGION 1..120: note = >huVH4-QRGG_I48L69
QVQLVQSGSELKKPGASVKVSCKASGYTFTSSGISWVRQAPGQGLEWIGEILPRSGYTNYNQGFTGRFVLSADKSVSTAYLQISSLKAEDTAVYYCARDFRSGRYAMDYWGQGTTVTVSS

SEQ ID NO: 197 - protein, 120 aa, synthetic construct
  REGION 1..120: note = >huVH4_D52Q61R97G99 Fab
QVQLVQSGSELKKPGASVKVSCKASGYTFTSSGISWVRQAPGQGLEWMGEIDPRSGYTNYNQGFTGRFVFSADKSVSTAYLQISSLKAEDTAVYYCARDFRSGRYAMDYWGQGTTVTVSS

SEQ ID NO: 198 - protein, 120 aa, synthetic construct
  REGION 1..120: note = >huVH4_G52Q61R97G99 Fab
QVQLVQSGSELKKPGASVKVSCKASGYTFTSSGISWVRQAPGQGLEWMGEIGPRSGYTNYNQGFTGRFVFSADKSVSTAYLQISSLKAEDTAVYYCARDFRSGRYAMDYWGQGTTVTVSS

SEQ ID NO: 199 - protein, 120 aa, synthetic construct
  REGION 1..120: note = >Tgex 207B7 huVH4_A52aQ61A97A99 IgG1
QVQLVQSGSELKKPGASVKVSCKASGYTFTSSGISWVRQAPGQGLEWMGEILARSGYTNYNQGFTGRFVFSADKSVSTAYLQISSLKAEDTAVYYCARDFASARYAMDYWGQGTTVTVSS

SEQ ID NO: 200 - protein, 120 aa, synthetic construct
  REGION 1..120: note = >Tgex 207B7 huVH4_D52aQ61A97A99 IgG1
QVQLVQSGSELKKPGASVKVSCKASGYTFTSSGISWVRQAPGQGLEWMGEILDRSGYTNYNQGFTGRFVFSADKSVSTAYLQISSLKAEDTAVYYCARDFASARYAMDYWGQGTTVTVSS

SEQ ID NO: 201 - protein, 120 aa, synthetic construct
  REGION 1..120: note = >Tgex 207B7 huVH4_F52aQ61A97A99 IgG1
QVQLVQSGSELKKPGASVKVSCKASGYTFTSSGISWVRQAPGQGLEWMGEILFRSGYTNYNQGFTGRFVFSADKSVSTAYLQISSLKAEDTAVYYCARDFASARYAMDYWGQGTTVTVSS

SEQ ID NO: 202 - protein, 120 aa, synthetic construct
  REGION 1..120: note = >Tgex 207B7 huVH4_G52aQ61A97A99 IgG1
QVQLVQSGSELKKPGASVKVSCKASGYTFTSSGISWVRQAPGQGLEWMGEILGRSGYTNYNQGFTGRFVFSADKSVSTAYLQISSLKAEDTAVYYCARDFASARYAMDYWGQGTTVTVSS

SEQ ID NO: 203 - protein, 120 aa, synthetic construct
  REGION 1..120: note = >Tgex 207B7 huVH4_N52aQ61A97A99 IgG1
QVQLVQSGSELKKPGASVKVSCKASGYTFTSSGISWVRQAPGQGLEWMGEILNRSGYTNYNQGFTGRFVFSADKSVSTAYLQISSLKAEDTAVYYCARDFASARYAMDYWGQGTTVTVSS

SEQ ID NO: 204 - protein, 120 aa, synthetic construct
  REGION 1..120: note = >Tgex 207B7 huVH4_A53Q61A97A99 IgG1
QVQLVQSGSELKKPGASVKVSCKASGYTFTSSGISWVRQAPGQGLEWMGEILPASGYTNYNQGFTGRFVFSADKSVSTAYLQISSLKAEDTAVYYCARDFASARYAMDYWGQGTTVTVSS

SEQ ID NO: 205 - protein, 120 aa, synthetic construct
  REGION 1..120: note = >Tgex 207B7 huVH4_D53Q61A97A99 IgG1
QVQLVQSGSELKKPGASVKVSCKASGYTFTSSGISWVRQAPGQGLEWMGEILPDSGYTNYNQGFTGRFVFSADKSVSTAYLQISSLKAEDTAVYYCARDFASARYAMDYWGQGTTVTVSS

SEQ ID NO: 206 - protein, 120 aa, synthetic construct
  REGION 1..120: note = >huVH4_D53Q61R97G99 Fab
QVQLVQSGSELKKPGASVKVSCKASGYTFTSSGISWVRQAPGQGLEWMGEILPDSGYTNYNQGFTGRFVFSADKSVSTAYLQISSLKAEDTAVYYCARDFRSGRYAMDYWGQGTTVTVSS

SEQ ID NO: 207 - protein, 120 aa, synthetic construct
  REGION 1..120: note = >Tgex 207B7 huVH4_E53Q61A97A99 IgG1
QVQLVQSGSELKKPGASVKVSCKASGYTFTSSGISWVRQAPGQGLEWMGEILPESGYTNYNQGFTGRFVFSADKSVSTAYLQISSLKAEDTAVYYCARDFASARYAMDYWGQGTTVTVSS

SEQ ID NO: 208 - protein, 120 aa, synthetic construct
  REGION 1..120: note = >Tgex 207B7 huVH4_G53Q61A97A99 IgG1
QVQLVQSGSELKKPGASVKVSCKASGYTFTSSGISWVRQAPGQGLEWMGEILPGSGYTNYNQGFTGRFVFSADKSVSTAYLQISSLKAEDTAVYYCARDFASARYAMDYWGQGTTVTVSS

SEQ ID NO: 209 - protein, 120 aa, synthetic construct
  REGION 1..120: note = >Tgex 207B7 huVH4_H53Q61A97A99 IgG1
QVQLVQSGSELKKPGASVKVSCKASGYTFTSSGISWVRQAPGQGLEWMGEILPHSGYTNYNQGFTGRFVFSADKSVSTAYLQISSLKAEDTAVYYCARDFASARYAMDYWGQGTTVTVSS

SEQ ID NO: 210 - protein, 120 aa, synthetic construct
  REGION 1..120: note = >Tgex 207B7 huVH4_I53Q61A97A99 IgG1
QVQLVQSGSELKKPGASVKVSCKASGYTFTSSGISWVRQAPGQGLEWMGEILPISGYTNYNQGFTGRFVFSADKSVSTAYLQISSLKAEDTAVYYCARDFASARYAMDYWGQGTTVTVSS

SEQ ID NO: 211 - protein, 120 aa, synthetic construct
  REGION 1..120: note = >Tgex 207B7 huVH4_K53Q61A97A99 IgG1
QVQLVQSGSELKKPGASVKVSCKASGYTFTSSGISWVRQAPGQGLEWMGEILPKSGYTNYNQGFTGRFVFSADKSVSTAYLQISSLKAEDTAVYYCARDFASARYAMDYWGQGTTVTVSS

SEQ ID NO: 212 - protein, 120 aa, synthetic construct
  REGION 1..120: note = >huVH4_K53Q61R97G99 Fab
QVQLVQSGSELKKPGASVKVSCKASGYTFTSSGISWVRQAPGQGLEWMGEILPKSGYTNYNQGFTGRFVFSADKSVSTAYLQISSLKAEDTAVYYCARDFRSGRYAMDYWGQGTTVTVSS

SEQ ID NO: 213 - protein, 120 aa, synthetic construct
  REGION 1..120: note = >Tgex 207B7 huVH4_L53Q61A97A99 IgG1
QVQLVQSGSELKKPGASVKVSCKASGYTFTSSGISWVRQAPGQGLEWMGEILPLSGYTNYNQGFTGRFVFSADKSVSTAYLQISSLKAEDTAVYYCARDFASARYAMDYWGQGTTVTVSS

SEQ ID NO: 214 - protein, 120 aa, synthetic construct
  REGION 1..120: note = >Tgex 207B7 huVH4_N53Q61A97A99 IgG1
QVQLVQSGSELKKPGASVKVSCKASGYTFTSSGISWVRQAPGQGLEWMGEILPNSGYTNYNQGFTGRFVFSADKSVSTAYLQISSLKAEDTAVYYCARDFASARYAMDYWGQGTTVTVSS

SEQ ID NO: 215 - protein, 120 aa, synthetic construct
  REGION 1..120: note = >Tgex 207B7 huVH4_Q53Q61A97A99 IgG1
QVQLVQSGSELKKPGASVKVSCKASGYTFTSSGISWVRQAPGQGLEWMGEILPQSGYTNYNQGFTGRFVFSADKSVSTAYLQISSLKAEDTAVYYCARDFASARYAMDYWGQGTTVTVSS

SEQ ID NO: 216 - protein, 120 aa, synthetic construct
  REGION 1..120: note = >huVH4_Q53Q61R97G99 Fab
QVQLVQSGSELKKPGASVKVSCKASGYTFTSSGISWVRQAPGQGLEWMGEILPQSGYTNYNQGFTGRFVFSADKSVSTAYLQISSLKAEDTAVYYCARDFRSGRYAMDYWGQGTTVTVSS

SEQ ID NO: 217 - protein, 120 aa, synthetic construct
  REGION 1..120: note = >huVH4_D54Q61R97G99 Fab
QVQLVQSGSELKKPGASVKVSCKASGYTFTSSGISWVRQAPGQGLEWMGEILPRDGYTNYNQGFTGRFVFSADKSVSTAYLQISSLKAEDTAVYYCARDFRSGRYAMDYWGQGTTVTVSS

SEQ ID NO: 218 - protein, 120 aa, synthetic construct
  REGION 1..120: note = >Tgex 207B7 huVH4_A55Q61A97A99 IgG1
QVQLVQSGSELKKPGASVKVSCKASGYTFTSSGISWVRQAPGQGLEWMGEILPRSAYTNYNQGFTGRFVFSADKSVSTAYLQISSLKAEDTAVYYCARDFASARYAMDYWGQGTTVTVSS

SEQ ID NO: 219 - protein, 120 aa, synthetic construct
  REGION 1..120: note = >Tgex 207B7 huVH4_D55Q61A97A99 IgG1
QVQLVQSGSELKKPGASVKVSCKASGYTFTSSGISWVRQAPGQGLEWMGEILPRSDYTNYNQGFTGRFVFSADKSVSTAYLQISSLKAEDTAVYYCARDFASARYAMDYWGQGTTVTVSS

SEQ ID NO: 220 - protein, 120 aa, synthetic construct
  REGION 1..120: note = >Tgex huVH4_D55Q61K97G98G99 sil (LALA_P331S)
QVQLVQSGSELKKPGASVKVSCKASGYTFTSSGISWVRQAPGQGLEWMGEILPRSDYTNYNQGFTGRFVFSADKSVSTAYLQISSLKAEDTAVYYCARDFKGGRYAMDYWGQGTTVTVSS

SEQ ID NO: 221 - protein, 120 aa, synthetic construct
  REGION 1..120: note = >Tgex huVH4_D55Q61R97G98G99 sil (LALA_P331S)
QVQLVQSGSELKKPGASVKVSCKASGYTFTSSGISWVRQAPGQGLEWMGEILPRSDYTNYNQGFTGRFVFSADKSVSTAYLQISSLKAEDTAVYYCARDFRGGRYAMDYWGQGTTVTVSS

SEQ ID NO: 222 - protein, 120 aa, synthetic construct
  REGION 1..120: note = >huVH4_D55Q61R97G99 Fab
QVQLVQSGSELKKPGASVKVSCKASGYTFTSSGISWVRQAPGQGLEWMGEILPRSDYTNYNQGFTGRFVFSADKSVSTAYLQISSLKAEDTAVYYCARDFRSGRYAMDYWGQGTTVTVSS

SEQ ID NO: 223 - protein, 120 aa, synthetic construct
  REGION 1..120: note = >Tgex huVH4_D55Q61_CDRH3-43sil (LALA_P331S)
QVQLVQSGSELKKPGASVKVSCKASGYTFTSSGISWVRQAPGQGLEWMGEILPRSDYTNYNQGFTGRFVFSADKSVSTAYLQISSLKAEDTAVYYCARDKGPSRYTMDYWGQGTTVTVSS

SEQ ID NO: 224 - protein, 120 aa, synthetic construct
  REGION 1..120: note = >Tgex 207B7 huVH4_E55Q61A97A99 IgG1
QVQLVQSGSELKKPGASVKVSCKASGYTFTSSGISWVRQAPGQGLEWMGEILPRSEYTNYNQGFTGRFVFSADKSVSTAYLQISSLKAEDTAVYYCARDFASARYAMDYWGQGTTVTVSS

SEQ ID NO: 225 - protein, 120 aa, synthetic construct
  REGION 1..120: note = >Tgex huVH4_E55Q61_CDRH3-43sil (LALA_P331S)
QVQLVQSGSELKKPGASVKVSCKASGYTFTSSGISWVRQAPGQGLEWMGEILPRSEYTNYNQGFTGRFVFSADKSVSTAYLQISSLKAEDTAVYYCARDKGPSRYTMDYWGQGTTVTVSS

SEQ ID NO: 226 - protein, 120 aa, synthetic construct
  REGION 1..120: note = >huVH4_D56Q61R97G99 Fab
QVQLVQSGSELKKPGASVKVSCKASGYTFTSSGISWVRQAPGQGLEWMGEILPRSGDTNYNQGFTGRFVFSADKSVSTAYLQISSLKAEDTAVYYCARDFRSGRYAMDYWGQGTTVTVSS

SEQ ID NO: 227 - protein, 120 aa, synthetic construct
  REGION 1..120: note = >huVH4_E56Q61R97G99 Fab
QVQLVQSGSELKKPGASVKVSCKASGYTFTSSGISWVRQAPGQGLEWMGEILPRSGETNYNQGFTGRFVFSADKSVSTAYLQISSLKAEDTAVYYCARDFRSGRYAMDYWGQGTTVTVSS

SEQ ID NO: 228 - protein, 120 aa, synthetic construct
  REGION 1..120: note = >Tgex 207B7 huVH4_N56Q61A97A99 IgG1
QVQLVQSGSELKKPGASVKVSCKASGYTFTSSGISWVRQAPGQGLEWMGEILPRSGNTNYNQGFTGRFVFSADKSVSTAYLQISSLKAEDTAVYYCARDFASARYAMDYWGQGTTVTVSS

SEQ ID NO: 229 - protein, 120 aa, synthetic construct
  REGION 1..120: note = >Tgex 207B7 huVH4_P57Q61A97A99 IgG1
QVQLVQSGSELKKPGASVKVSCKASGYTFTSSGISWVRQAPGQGLEWMGEILPRSGYPNYNQGFTGRFVFSADKSVSTAYLQISSLKAEDTAVYYCARDFASARYAMDYWGQGTTVTVSS

SEQ ID NO: 230 - protein, 120 aa, synthetic construct
  REGION 1..120: note = >huVH4_D58Q61R97G99 Fab
QVQLVQSGSELKKPGASVKVSCKASGYTFTSSGISWVRQAPGQGLEWMGEILPRSGYTDYNQGFTGRFVFSADKSVSTAYLQISSLKAEDTAVYYCARDFRSGRYAMDYWGQGTTVTVSS

SEQ ID NO: 231 - protein, 120 aa, synthetic construct
  REGION 1..120: note = >huVH4_E58Q61R97G99 Fab
QVQLVQSGSELKKPGASVKVSCKASGYTFTSSGISWVRQAPGQGLEWMGEILPRSGYTEYNQGFTGRFVFSADKSVSTAYLQISSLKAEDTAVYYCARDFRSGRYAMDYWGQGTTVTVSS

SEQ ID NO: 232 - protein, 120 aa, synthetic construct
  REGION 1..120: note = >Tgex 207B7 huVH4_H58Q61-CDRH3-4-1- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDAGHARYTMDYWGQGTTVTVSS

SEQ ID NO: 233 - protein, 120 aa, synthetic construct
  REGION 1..120: note = >Tgex 207B7 huVH4_H58Q61-CDRH3-4-5- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFGHGRYALDYWGQGTTVTVSS

SEQ ID NO: 234 - protein, 121 aa, synthetic construct
  REGION 1..121: note = >Tgex 207B7 huVH4_H58Q61Q99ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFGSQSRYAMDYWGQGTTVTVSS

SEQ ID NO: 235 - protein, 120 aa, synthetic construct
  REGION 1..120: note = >Tgex 207B7 huVH4_H58Q61K97G98G99- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFKGGRYAMDYWGQGTTVTVSS

SEQ ID NO: 236 - protein, 121 aa, synthetic construct
  REGION 1..121: note = >Tgex 207B7 huVH4_H58Q61K97ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFKGSSRYAMDYWGQGTTVTVSS

SEQ ID NO: 237 - protein, 122 aa, synthetic construct
  REGION 1..122: note = >Tgex 207B7 huVH4_H58Q61K97insQ98ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFKQGSSRYAMDYWGQGTTVTVSS

SEQ ID NO: 238 - protein, 121 aa, synthetic construct
  REGION 1..121: note = >Tgex 207B7 huVH4_H58Q61Q97ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFQGSSRYAMDYWGQGTTVTVSS

SEQ ID NO: 239 - protein, 122 aa, synthetic construct
  REGION 1..122: note = >Tgex 207B7 huVH4_H58Q61Q97insK98ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFQKGSSRYAMDYWGQGTTVTVSS

SEQ ID NO: 240 - protein, 121 aa, synthetic construct
  REGION 1..121: note = >Tgex 207B7 huVH4_H58Q61R97ins- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDFRGSSRYAMDYWGQGTTVTVSS

SEQ ID NO: 241 - protein, 120 aa, synthetic construct
  REGION 1..120: note = >Tgex 207B7 huVH4_H58Q61-CDRH3-4-18- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDGNGARYTLDYWGQGTTVTVSS

SEQ ID NO: 242 - protein, 120 aa, synthetic construct
  REGION 1..120: note = >Tgex 207B7 huVH4_H58Q61-CDRH3-4-20- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDGNHARYSLDYWGQGTTVTVSS

SEQ ID NO: 243 - protein, 120 aa, synthetic construct
  REGION 1..120: note = >Tgex 207B7 huVH4_H58Q61-CDRH3-4-21- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDGNYSRYSMDYWGQGTTVTVSS

SEQ ID NO: 244 - protein, 120 aa, synthetic construct
  REGION 1..120: note = >Tgex 207B7 huVH4_H58Q61-CDRH3-4-24- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDGTHTRYAMDYWGQGTTVTVSS

SEQ ID NO: 245 - protein, 120 aa, synthetic construct
  REGION 1..120: note = >Tgex 207B7 huVH4_H58Q61-CDRH3-4-26- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDGTNTRYAMDYWGQGTTVTVSS

SEQ ID NO: 246 - protein, 119 aa, synthetic construct
  REGION 1..119: note = >Tgex 207B7 huVH4_H58Q61CDRH3-7-30- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPARYAMDYWGQGTTVTVSS

SEQ ID NO: 247 - protein, 121 aa, synthetic construct
  REGION 1..121: note = >Tgex 207B7 huVH4_H58Q61CDRH3-7-39- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPHAARYAMDYWGQGTTVTVSS

SEQ ID NO: 248 - protein, 120 aa, synthetic construct
  REGION 1..120: note = >Tgex 207B7 huVH4_H58Q61-CDRH3-4-40- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPHARYSMDYWGQGTTVTVSS

SEQ ID NO: 249 - protein, 121 aa, synthetic construct
  REGION 1..121: note = >Tgex 207B7 huVH4_H58Q61CDRH3-7-41- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPHFIRYAMDYWGQGTTVTVSS

SEQ ID NO: 250 - protein, 120 aa, synthetic construct
  REGION 1..120: note = >Tgex 207B7 huVH4_H58Q61-CDRH3-4-46- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPHVRYEMDYWGQGTTVTVSS

SEQ ID NO: 251 - protein, 120 aa, synthetic construct
  REGION 1..120: note = >Tgex 207B7 huVH4_H58Q61-CDRH3-4-60- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPSGRYTMDYWGQGTTVTVSS

SEQ ID NO: 252 - protein, 119 aa, synthetic construct
  REGION 1..119: note = >Tgex 207B7 huVH4_H58Q61CDRH3-7-63- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPTRYAMDYWGQGTTVTVSS

SEQ ID NO: 253 - protein, 119 aa, synthetic construct
  REGION 1..119: note = >Tgex 207B7 huVH4_H58Q61CDRH3-7-64- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHPVRYAMDYWGQGTTVTVSS

SEQ ID NO: 254 - protein, 120 aa, synthetic construct
  REGION 1..120: note = >Tgex 207B7 huVH4_H58Q61-CDRH3-4-76- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDHTPVRYAMDYWGQGTTVTVSS

SEQ ID NO: 255 - protein, 120 aa, synthetic construct
  REGION 1..120: note = >Tgex 207B7 huVH4_H58Q61KPA99T- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDKGPARYTMDYWGQGTTVTVSS

SEQ ID NO: 256 - protein, 120 aa, synthetic construct
  REGION 1..120: note = >Tgex 207B7 huVH4_H58Q61-CDRH3-43- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDKGPSRYTMDYWGQGTTVTVSS

SEQ ID NO: 257 - protein, 120 aa, synthetic construct
  REGION 1..120: note = >Tgex 207B7 huVH4_H58Q61-CDRH3-4-80- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDMQHTRYSLDYWGQGTTVTVSS

SEQ ID NO: 258 - protein, 119 aa, synthetic construct
  REGION 1..119: note = >Tgex 207B7 huVH4_H58Q61CDRH3-7-82- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDNNHRYAMDYWGQGTTVTVSS

SEQ ID NO: 259 - protein, 120 aa, synthetic construct
  REGION 1..120: note = >Tgex 207B7 huVH4_H58Q61-CDRH3-4-84- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDPTSVRYALDYWGQGTTVTVSS

SEQ ID NO: 260 - protein, 120 aa, synthetic construct
  REGION 1..120: note = >Tgex 207B7 huVH4_H58Q61-CDRH3-4-90- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDSPPVRYSLDYWGQGTTVTVSS

SEQ ID NO: 261 - protein, 120 aa, synthetic construct
  REGION 1..120: note = >Tgex 207B7 huVH4_H58Q61-CDRH3-4-92- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDSYTSRYSLDYWGQGTTVTVSS

SEQ ID NO: 262 - protein, 120 aa, synthetic construct
  REGION 1..120: note = >Tgex 207B7 huVH4_H58Q61-CDRH3-4-96- sil (LALA_P331S)
QVQLVQSGSELKKPGASVKVSCKASGYTFTSSGISWVRQAPGQGLEWMGEILPRSGYTHYNQGFTGRFVFSADKSVSTAYLQISSLKAEDTAVYYCARDWMQARYSLDYWGQGTTVTVSS

SEQ ID NO: 263 - protein, 120 aa, synthetic construct
  REGION 1..120: note = >Tgex 207B7 huVH4_K60Q61A97A99 IgG1
QVQLVQSGSELKKPGASVKVSCKASGYTFTSSGISWVRQAPGQGLEWMGEILPRSGYTNYKQGFTGRFVFSADKSVSTAYLQISSLKAEDTAVYYCARDFASARYAMDYWGQGTTVTVSS

SEQ ID NO: 264 - protein, 120 aa, synthetic construct
  REGION 1..120: note = >Tgex 207B7 huVH4_K60Q61K97G99 IgG1
QVQLVQSGSELKKPGASVKVSCKASGYTFTSSGISWVRQAPGQGLEWMGEILPRSGYTNYKQGFTGRFVFSADKSVSTAYLQISSLKAEDTAVYYCARDFKSGRYAMDYWGQGTTVTVSS

SEQ ID NO: 265 - protein, 120 aa, synthetic construct
  REGION 1..120: note = >Tgex 207B7 huVH4_K60Q61K62A97A99 IgG1
QVQLVQSGSELKKPGASVKVSCKASGYTFTSSGISWVRQAPGQGLEWMGEILPRSGYTNYKQKFTGRFVFSADKSVSTAYLQISSLKAEDTAVYYCARDFASARYAMDYWGQGTTVTVSS

SEQ ID NO: 266 - protein, 120 aa, synthetic construct
  REGION 1..120: note = >Tgex 207B7 huVH4_K60Q61K62K97G99 IgG1
QVQLVQSGSELKKPGASVKVSCKASGYTFTSSGISWVRQAPGQGLEWMGEILPRSGYTNYKQKFTGRFVFSADKSVSTAYLQISSLKAEDTAVYYCARDFKSGRYAMDYWGQGTTVTVSS

SEQ ID NO: 267 - protein, 120 aa, synthetic construct
  REGION 1..120: note = >huVH4_A61A97A99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFASARYAMDYWGQGTTVTVSS

SEQ ID NO: 268 - protein, 120 aa, synthetic construct
  REGION 1..120: note = >huVH4_A61A97A99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFASARYAMDYWSQGTTVTVSS

SEQ ID NO: 269 - protein, 120 aa, synthetic construct
  REGION 1..120: note = >huVH4_A61A97G99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFASGRYAMDYWGQGTTVTVSS

SEQ ID NO: 270 - protein, 120 aa, synthetic construct
  REGION 1..120: note = >huVH4_A61A97S99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFASSRYAMDYWGQGTTVTVSS

SEQ ID NO: 271 - protein, 120 aa, synthetic construct
  REGION 1..120: note = >huVH4_A61A97S99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFASSRYAMDYWSQGTTVTVSS

SEQ ID NO: 272 - protein, 120 aa, synthetic construct
  REGION 1..120: note = >huVH4_A61G97A99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSARYAMDYWGQGTTVTVSS

SEQ ID NO: 273 - protein, 120 aa, synthetic construct
  REGION 1..120: note = >huVH4_A61G97A99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSARYAMDYWSQGTTVTVSS

SEQ ID NO: 274 - protein, 120 aa, synthetic construct
  REGION 1..120: note = >huVH4_A61G97G99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSGRYAMDYWGQGTTVTVSS

SEQ ID NO: 275 - protein, 120 aa, synthetic construct
  REGION 1..120: note = >huVH4_A61G97G99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSGRYAMDYWSQGTTVTVSS

SEQ ID NO: 276 - protein, 120 aa, synthetic construct
  REGION 1..120: note = >huVH4_A61G97S99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSSRYAMDYWGQGTTVTVSS

SEQ ID NO: 277 - protein, 120 aa, synthetic construct
  REGION 1..120: note = >huVH4_A61G97S99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFGSSRYAMDYWSQGTTVTVSS

SEQ ID NO: 278 - protein, 120 aa, synthetic construct
  REGION 1..120: note = >huVH4_A61R97A99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFRSARYAMDYWGQGTTVTVSS

SEQ ID NO: 279 - protein, 120 aa, synthetic construct
  REGION 1..120: note = >huVH4_A61R97A99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFRSARYAMDYWSQGTTVTVSS

SEQ ID NO: 280 - protein, 120 aa, synthetic construct
  REGION 1..120: note = >huVH4_A61R97G99G104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFRSGRYAMDYWGQGTTVTVSS

SEQ ID NO: 281 - protein, 120 aa, synthetic construct
  REGION 1..120: note = >huVH4_A61R97G99S104
QVQLVQSGSELKKPGASVKVSCKASGYTFTSSGISWVRQAPGQGLEWMGEILPRSGYTNYNAGFTGRFVFSADKSVSTAYLQISSLKAEDTAVYYCARDFRSGRYAMDYWSQGTTVTVSS

SEQ ID NO: 282 - protein, 120 aa, synthetic construct
  REGION 1..120: note = >207B7-HuVH4_D61
QVQLVQSGSELKKPGASVKVSCKASGYTFTSSGISWVRQAPGQGLEWMGEILPRSGYTNYNDGFTGRFVFSADKSVSTAYLQISSLKAEDTAVYYCARDFGSSRYAMDYWGQGTTVTVSS

SEQ ID NO: 283 - protein, 120 aa, synthetic construct
  REGION 1..120: note = >huVH4_E61A97A99G104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFASARYAMDYWGQGTTVTVSS

SEQ ID NO: 284 - protein, 120 aa, synthetic construct
  REGION 1..120: note = >huVH4_E61A97A99S104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFASARYAMDYWSQGTTVTVSS

SEQ ID NO: 285 - protein, 120 aa, synthetic construct
  REGION 1..120: note = >huVH4_E61A97S99G104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFASSRYAMDYWGQGTTVTVSS

SEQ ID NO: 286 - protein, 120 aa, synthetic construct
  REGION 1..120: note = >huVH4_E61A97S99S104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFASSRYAMDYWSQGTTVTVSS

SEQ ID NO: 287 - protein, 120 aa, synthetic construct
  REGION 1..120: note = >207B7-HuVH4_D97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFDSSRYAMDYWGQGTTVTVSS

SEQ ID NO: 288 - protein, 120 aa, synthetic construct
  REGION 1..120: note = >207B7-HuVH4_E97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFESSRYAMDYWGQGTTVTVSS

SEQ ID NO: 289 - protein, 120 aa, synthetic construct
  REGION 1..120: note = >207B7-HuVH4_F97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFFSSRYAMDYWGQGTTVTVSS

SEQ ID NO: 290 - protein, 120 aa, synthetic construct
  REGION 1..120: note = >huVH4_E61G97A99G104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSARYAMDYWGQGTTVTVSS

SEQ ID NO: 291 - protein, 120 aa, synthetic construct
  REGION 1..120: note = >huVH4_E61G97A99S104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSARYAMDYWSQGTTVTVSS

SEQ ID NO: 292 - protein, 120 aa, synthetic construct
  REGION 1..120: note = >207B7-HuVH4_D99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSDRYAMDYWGQGTTVTVSS

SEQ ID NO: 293 - protein, 120 aa, synthetic construct
  REGION 1..120: note = >207B7-HuVH4_E99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSERYAMDYWGQGTTVTVSS

SEQ ID NO: 294 - protein, 120 aa, synthetic construct
  REGION 1..120: note = >207B7-HuVH4_F99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSFRYAMDYWGQGTTVTVSS

SEQ ID NO: 295 - protein, 120 aa, synthetic construct
  REGION 1..120: note = >207B7-HuVH4_G99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSGRYAMDYWGQGTTVTVSS

SEQ ID NO: 296 - protein, 120 aa, synthetic construct
  REGION 1..120: note = >207B7-HuVH4_H99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSHRYAMDYWGQGTTVTVSS

SEQ ID NO: 297 - protein, 120 aa, synthetic construct
  REGION 1..120: note = >207B7-HuVH4_I99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSIRYAMDYWGQGTTVTVSS

SEQ ID NO: 298 - protein, 120 aa, synthetic construct
  REGION 1..120: note = >207B7-HuVH4_K99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSKRYAMDYWGQGTTVTVSS

SEQ ID NO: 299 - protein, 120 aa, synthetic construct
  REGION 1..120: note = >207B7-HuVH4_L99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSLRYAMDYWGQGTTVTVSS

SEQ ID NO: 300 - protein, 120 aa, synthetic construct
  REGION 1..120: note = >207B7-HuVH4_M99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSMRYAMDYWGQGTTVTVSS

SEQ ID NO: 301 - protein, 120 aa, synthetic construct
  REGION 1..120: note = >207B7-HuVH4_N99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSNRYAMDYWGQGTTVTVSS

SEQ ID NO: 302 - protein, 120 aa, synthetic construct
  REGION 1..120: note = >207B7-HuVH4_P99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSPRYAMDYWGQGTTVTVSS

SEQ ID NO: 303 - protein, 120 aa, synthetic construct
  REGION 1..120: note = >207B7-HuVH4_Q99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSQRYAMDYWGQGTTVTVSS

SEQ ID NO: 304 - protein, 120 aa, synthetic construct
  REGION 1..120: note = >207B7-HuVH4_R99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSRRYAMDYWGQGTTVTVSS

SEQ ID NO: 305 - protein, 120 aa, synthetic construct; identical to SEQ ID NO: 33
  REGION 1..120: note = >huVH4_E61G97S99G104

SEQ ID NO: 306 - protein, 120 aa, synthetic construct
  REGION 1..120: note = >huVH4_E61G97S99S104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSSRYAMDYWSQGTTVTVSS

SEQ ID NO: 307 - protein, 120 aa, synthetic construct
  REGION 1..120: note = >207B7-HuVH4_T99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSTRYAMDYWGQGTTVTVSS

SEQ ID NO: 308 - protein, 120 aa, synthetic construct
  REGION 1..120: note = >207B7-HuVH4_V99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSVRYAMDYWGQGTTVTVSS

SEQ ID NO: 309 - protein, 120 aa, synthetic construct
  REGION 1..120: note = >207B7-HuVH4_W99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSWRYAMDYWGQGTTVTVSS

SEQ ID NO: 310 - protein, 120 aa, synthetic construct
  REGION 1..120: note = >207B7-HuVH4_Y99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFGSYRYAMDYWGQGTTVTVSS

SEQ ID NO: 311 - protein, 120 aa, synthetic construct
  REGION 1..120: note = >207B7-HuVH4_H97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFHSSRYAMDYWGQGTTVTVSS

SEQ ID NO: 312 - protein, 120 aa, synthetic construct
  REGION 1..120: note = >207B7-HuVH4_I97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFISSRYAMDYWGQGTTVTVSS

SEQ ID NO: 313 - protein, 120 aa, synthetic construct
  REGION 1..120: note = >207B7-HuVH4_K97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFKSSRYAMDYWGQGTTVTVSS

SEQ ID NO: 314 - protein, 120 aa, synthetic construct
  REGION 1..120: note = >207B7-HuVH4_L97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFLSSRYAMDYWGQGTTVTVSS

SEQ ID NO: 315 - protein, 120 aa, synthetic construct
  REGION 1..120: note = >207B7-HuVH4_M97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFMSSRYAMDYWGQGTTVTVSS

SEQ ID NO: 316 - protein, 120 aa, synthetic construct
  REGION 1..120: note = >207B7-HuVH4_N97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFNSSRYAMDYWGQGTTVTVSS

SEQ ID NO: 317 - protein, 120 aa, synthetic construct
  REGION 1..120: note = >207B7-HuVH4_P97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFPSSRYAMDYWGQGTTVTVSS

SEQ ID NO: 318 - protein, 120 aa, synthetic construct
  REGION 1..120: note = >207B7-HuVH4_Q97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFQSSRYAMDYWGQGTTVTVSS

SEQ ID NO: 319 - protein, 120 aa, synthetic construct
  REGION 1..120: note = >huVH4_E61R97G99G104
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFRSGRYAMDYWGQGTTVTVSS

SEQ ID NO: 320 - protein, 120 aa, synthetic construct
  REGION 1..120: note = >207B7-HuVH4_R97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFRSSRYAMDYWGQGTTVTVSS

SEQ ID NO: 321 - protein, 120 aa, synthetic construct
  REGION 1..120: note = >207B7-HuVH4_S97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFSSSRYAMDYWGQGTTVTVSS

SEQ ID NO: 322 - protein, 120 aa, synthetic construct
  REGION 1..120: note = >207B7-HuVH4_T97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFTSSRYAMDYWGQGTTVTVSS

SEQ ID NO: 323 - protein, 120 aa, synthetic construct
  REGION 1..120: note = >207B7-HuVH4_V97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFVSSRYAMDYWGQGTTVTVSS

SEQ ID NO: 324 - protein, 120 aa, synthetic construct
  REGION 1..120: note = >207B7-HuVH4_W97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFWSSRYAMDYWGQGTTVTVSS

SEQ ID NO: 325 - protein, 120 aa, synthetic construct
  REGION 1..120: note = >207B7-HuVH4_Y97
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFYSSRYAMDYWGQGTTVTVSS

SEQ ID NO: 326 - protein, 120 aa, synthetic construct
  REGION 1..120: note = >207B7-HuVH4_F61
QVQLVQSGSELKKPGASVKVSCKASGYTFTSSGISWVRQAPGQGLEWMGEILPRSGYTNYNFGFTGRFVFSADKSVSTAYLQISSLKAEDTAVYYCARDFGSSRYAMDYWGQGTTVTVSS

SEQ ID NO: 327 - protein, 120 aa, synthetic construct
  REGION 1..120: note = >huVH4_G61A97A99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFASARYAMDYWGQGTTVTVSS

SEQ ID NO: 328 - protein, 120 aa, synthetic construct
  REGION 1..120: note = >huVH4_G61A97A99S104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFASARYAMDYWSQGTTVTVSS

SEQ ID NO: 329 - protein, 120 aa, synthetic construct
  REGION 1..120: note = >huVH4_G61A97S99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFASSRYAMDYWGQGTTVTVSS

SEQ ID NO: 330 - protein, 120 aa, synthetic construct
  REGION 1..120: note = >huVH4_G61A97S99S104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFASSRYAMDYWSQGTTVTVSS

SEQ ID NO: 331 - protein, 120 aa, synthetic construct
  REGION 1..120: note = >huVH4_G61G97A99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFGSARYAMDYWGQGTTVTVSS

SEQ ID NO: 332 - protein, 120 aa, synthetic construct
  REGION 1..120: note = >huVH4_G61G97A99S104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFGSARYAMDYWSQGTTVTVSS

SEQ ID NO: 333 - protein, 120 aa, synthetic construct
  REGION 1..120: note = >huVH4_G61G97G99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFGSGRYAMDYWGQGTTVTVSS

SEQ ID NO: 334 - protein, 120 aa, synthetic construct
  REGION 1..120: note = >huVH4_G61G97S99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFGSSRYAMDYWGQGTTVTVSS

SEQ ID NO: 335 - protein, 120 aa, synthetic construct
  REGION 1..120: note = >huVH4_G61G97S99S104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFGSSRYAMDYWSQGTTVTVSS

SEQ ID NO: 336 - protein, 120 aa, synthetic construct
  REGION 1..120: note = >huVH4_G61R97A99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFRSARYAMDYWGQGTTVTVSS

SEQ ID NO: 337 - protein, 120 aa, synthetic construct
  REGION 1..120: note = >huVH4_G61R97G99G104
QVQLVQSGSELKKPGASVKVSCKASGYTFTSSGISWVRQAPGQGLEWMGEILPRSGYTNYNGGFTGRFVFSADKSVSTAYLQISSLKAEDTAVYYCARDFRSGRYAMDYWGQGTTVTVSS

SEQ ID NO: 338 - protein, 120 aa, synthetic construct
  REGION 1..120: note = >207B7-HuVH4_H61
QVQLVQSGSELKKPGASVKVSCKASGYTFTSSGISWVRQAPGQGLEWMGEILPRSGYTNYNHGFTGRFVFSADKSVSTAYLQISSLKAEDTAVYYCARDFGSSRYAMDYWGQGTTVTVSS

SEQ ID NO: 339 - protein, 120 aa, synthetic construct
  REGION 1..120: note = >207B7-HuVH4_I61
QVQLVQSGSELKKPGASVKVSCKASGYTFTSSGISWVRQAPGQGLEWMGEILPRSGYTNYNIGFTGRFVFSADKSVSTAYLQISSLKAEDTAVYYCARDFGSSRYAMDYWGQGTTVTVSS

SEQ ID NO: 340 - protein, 120 aa, synthetic construct
  REGION 1..120: note = >207B7-HuVH4_K61
QVQLVQSGSELKKPGASVKVSCKASGYTFTSSGISWVRQAPGQGLEWMGEILPRSGYTNYNKGFTGRFVFSADKSVSTAYLQISSLKAEDTAVYYCARDFGSSRYAMDYWGQGTTVTVSS

SEQ ID NO: 341 - protein, 120 aa, synthetic construct
  REGION 1..120: note = >207B7-HuVH4_L61
QVQLVQSGSELKKPGASVKVSCKASGYTFTSSGISWVRQAPGQGLEWMGEILPRSGYTNYNLGFTGRFVFSADKSVSTAYLQISSLKAEDTAVYYCARDFGSSRYAMDYWGQGTTVTVSS

SEQ ID NO: 342 - protein, 120 aa, synthetic construct
  REGION 1..120: note = >207B7-HuVH4_M61
QVQLVQSGSELKKPGASVKVSCKASGYTFTSSGISWVRQAPGQGLEWMGEILPRSGYTNYNMGFTGRFVFSADKSVSTAYLQISSLKAEDTAVYYCARDFGSSRYAMDYWGQGTTVTVSS

SEQ ID NO: 343 - protein, 120 aa, synthetic construct
  REGION 1..120: note = >207B7-HuVH4_N61
QVQLVQSGSELKKPGASVKVSCKASGYTFTSSGISWVRQAPGQGLEWMGEILPRSGYTNYNNGFTGRFVFSADKSVSTAYLQISSLKAEDTAVYYCARDFGSSRYAMDYWGQGTTVTVSS

SEQ ID NO: 344 - protein, 120 aa, synthetic construct
  REGION 1..120: note = >207B7-HuVH4_P61
QVQLVQSGSELKKPGASVKVSCKASGYTFTSSGISWVRQAPGQGLEWMGEILPRSGYTNYNPGFTGRFVFSADKSVSTAYLQISSLKAEDTAVYYCARDFGSSRYAMDYWGQGTTVTVSS

SEQ ID NO: 345 - protein, 120 aa, synthetic construct
  REGION 1..120: note = >huVH4_Q61A62K97G99 IgG
QVQLVQSGSELKKPGASVKVSCKASGYTFTSSGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 346 - protein, 120 aa, synthetic construct
  REGION 1..120: note = >huVH4_Q61E62K97G99 IgG
QVQLVQSGSELKKPGASVKVSCKASGYTFTSSGISWVRQAPGQGLEWMGEILPRSGYTNYNQEFTGRFVFSADKSVSTAYLQISSLKAEDTAVYYCARDFKSGRYAMDYWGQGTTVTVSS

SEQ ID NO: 347 - protein, 120 aa, synthetic construct
  REGION 1..120: note = >Tgex 207B7 huVH4_Q61E64A97A99 IgG1
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDFASARYAMDYWGQGTTVTVSS

SEQ ID NO: 348 - protein, 120 aa, synthetic construct
  REGION 1..120: note = >Tgex huVH4_Q61E64K97G98G99 sil (LALA_P331S)
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDFKGGRYAMDYWGQGTTVTVSS

SEQ ID NO: 349 - protein, 120 aa, synthetic construct
  REGION 1..120: note = >Tgex 207B7 huVH4_Q61E64K97G99 IgG1
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDFKSGRYAMDYWGQGTTVTVSS

SEQ ID NO: 350 - protein, 120 aa, synthetic construct
  REGION 1..120: note = >Tgex huVH4_Q61E64R97G98G99 sil (LALA_P331S)
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDFRGGRYAMDYWGQGTTVTVSS

SEQ ID NO: 351 - protein, 120 aa, synthetic construct
  REGION 1..120: note = >huVH4_Q61E64R97G99 Fab
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDFRSGRYAMDYWGQGTTVTVSS

SEQ ID NO: 352 - protein, 120 aa, synthetic construct
  REGION 1..120: note = >Tgex huVH4_Q61E64_CDRH3-43sil (LALA_P331S)
QVQLVQSGSELKKPGASVKVSCKASGYTFTSSGISWVRQAPGQGLEWMGEILPRSGYTNYNQGFEGRFVFSADKSVSTAYLQISSLKAEDTAVYYCARDKGPSRYTMDYWGQGTTVTVSS

SEQ ID NO: 353 - protein, 120 aa, synthetic construct
  REGION 1..120: note = >Tgex 207B7 huVH4_Q61K64A97A99 IgG1
QVQLVQSGSELKKPGASVKVSCKASGYTFTSSGISWVRQAPGQGLEWMGEILPRSGYTNYNQGFKGRFVFSADKSVSTAYLQISSLKAEDTAVYYCARDFASARYAMDYWGQGTTVTVSS

SEQ ID NO: 354 - protein, 120 aa, synthetic construct
  REGION 1..120: note = >Tgex 207B7 huVH4_Q61K64K97G99 IgG1
QVQLVQSGSELKKPGASVKVSCKASGYTFTSSGISWVRQAPGQGLEWMGEILPRSGYTNYNQGFKGRFVFSADKSVSTAYLQISSLKAEDTAVYYCARDFKSGRYAMDYWGQGTTVTVSS

SEQ ID NO: 355 - protein, 120 aa, synthetic construct
  REGION 1..120: note = >huVH4_Q61K64R97G99 Fab
QVQLVQSGSELKKPGASVKVSCKASGYTFTSSGISWVRQAPGQGLEWMGEILPRSGYTNYNQGFKGRFVFSADKSVSTAYLQISSLKAEDTAVYYCARDFRSGRYAMDYWGQGTTVTVSS

SEQ ID NO: 356 - protein, 120 aa, synthetic construct
  REGION 1..120: note = >huVH4_Q61M64R97G99 Fab
QVQLVQSGSELKKPGASVKVSCKASGYTFTSSGISWVRQAPGQGLEWMGEILPRSGYTNYNQGFMGRFVFSADKSVSTAYLQISSLKAEDTAVYYCARDFRSGRYAMDYWGQGTTVTVSS

SEQ ID NO: 357 - protein, 120 aa, synthetic construct
  REGION 1..120: note = >Tgex 207B7 huVH4_Q61Q64A97A99 IgG1
QVQLVQSGSELKKPGASVKVSCKASGYTFTSSGISWVRQAPGQGLEWMGEILPRSGYTNYNQGFQGRFVFSADKSVSTAYLQISSLKAEDTAVYYCARDFASARYAMDYWGQGTTVTVSS

SEQ ID NO: 358 - protein, 120 aa, synthetic construct
  REGION 1..120: note = >Tgex 207B7 huVH4_Q61Q64K97G99 IgG1
QVQLVQSGSELKKPGASVKVSCKASGYTFTSSGISWVRQAPGQGLEWMGEILPRSGYTNYNQGFQGRFVFSADKSVSTAYLQISSLKAEDTAVYYCARDFKSGRYAMDYWGQGTTVTVSS

SEQ ID NO: 359 - protein, 120 aa, synthetic construct
  REGION 1..120: note = >huVH4_Q61Q64R97G99 Fab
QVQLVQSGSELKKPGASVKVSCKASGYTFTSSGISWVRQAPGQGLEWMGEILPRSGYTNYNQGFQGRFVFSADKSVSTAYLQISSLKAEDTAVYYCARDFRSGRYAMDYWGQGTTVTVSS

SEQ ID NO: 360 - protein, 120 aa, synthetic construct
  REGION 1..120: note = >huVH4_Q61R64R97G99 Fab
QVQLVQSGSELKKPGASVKVSCKASGYTFTSSGISWVRQAPGQGLEWMGEILPRSGYTNYNQGFRGRFVFSADKSVSTAYLQISSLKAEDTAVYYCARDFRSGRYAMDYWGQGTTVTVSS

SEQ ID NO: 361 - protein, 120 aa, synthetic construct
  REGION 1..120: note = >huVH4-QRGG_S75F91
QVQLVQSGSELKKPGASVKVSCKASGYTFTSSGISWVRQAPGQGLEWMGEILPRSGYTNYNQGFTGRFVFSADKSSSTAYLQISSLKAEDTAVYFCARDFRSGRYAMDYWGQGTTVTVSS

SEQ ID NO: 362 - protein, 120 aa, synthetic construct
  REGION 1..120: note = >Tgex huVH4_Q61S75K97G98G99 sil (LALA_P331S)
QVQLVQSGSELKKPGASVKVSCKASGYTFTSSGISWVRQAPGQGLEWMGEILPRSGYTNYNQGFTGRFVFSADKSSSTAYLQISSLKAEDTAVYYCARDFKGGRYAMDYWGQGTTVTVSS

SEQ ID NO: 363 - protein, 120 aa, synthetic construct
  REGION 1..120: note = >Tgex huVH4_Q61S75R97G98G99 sil (LALA_P331S)
QVQLVQSGSELKKPGASVKVSCKASGYTFTSSGISWVRQAPGQGLEWMGEILPRSGYTNYNQGFTGRFVFSADKSSSTAYLQISSLKAEDTAVYYCARDFRGGRYAMDYWGQGTTVTVSS

SEQ ID NO: 364 - protein, 120 aa, synthetic construct
  REGION 1..120: note = >huVH4-QRGG_S75
QVQLVQSGSELKKPGASVKVSCKASGYTFTSSGISWVRQAPGQGLEWMGEILPRSGYTNYNQGFTGRFVFSADKSSSTAYLQISSLKAEDTAVYYCARDFRSGRYAMDYWGQGTTVTVSS

SEQ ID NO: 365 - protein, 120 aa, synthetic construct
  REGION 1..120: note = >Tgex huVH4_Q61S75_CDRH3-43_Fab
QVQLVQSGSELKKPGASVKVSCKASGYTFTSSGISWVRQAPGQGLEWMGEILPRSGYTNYNQGFTGRFVFSADKSSSTAYLQISSLKAEDTAVYYCARDKGPSRYTMDYWGQGTTVTVSS

SEQ ID NO: 366 - protein, 120 aa, synthetic construct
  REGION 1..120: note = >huVH4-QRGG_F91
QVQLVQSGSELKKPGASVKVSCKASGYTFTSSGISWVRQAPGQGLEWMGEILPRSGYTNYNQGFTGRFVFSADKSVSTAYLQISSLKAEDTAVYFCARDFRSGRYAMDYWGQGTTVTVSS

SEQ ID NO: 367 - protein, 120 aa, synthetic construct
  REGION 1..120: note = >Tgex 207B7 huVH4_Q61-CDRH3-4-1- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDAGHARYTMDYWGQGTTVTVSS

SEQ ID NO: 368 - protein, 120 aa, synthetic construct
  REGION 1..120: note = >Tgex 207B7 huVH4_Q61A97A99L100c IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYALDYWGQGTTVTVSS

SEQ ID NO: 369 - protein, 120 aa, synthetic construct
  REGION 1..120: note = >huVH4_Q61A97A99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYAMDYWGQGTTVTVSS

SEQ ID NO: 370 - protein, 120 aa, synthetic construct
  REGION 1..120: note = >Tgex 207B7 huVH4_Q61A99A97D100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYDMDYWGQGTTVTVSS

SEQ ID NO: 371 - protein, 120 aa, synthetic construct
  REGION 1..120: note = >Tgex 207B7 huVH4_Q61A99A97E100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYEMDYWGQGTTVTVSS

SEQ ID NO: 372 - protein, 120 aa, synthetic construct
  REGION 1..120: note = >Tgex 207B7 huVH4_Q61A97A99S100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYSMDYWGQGTTVTVSS

SEQ ID NO: 373 - protein, 120 aa, synthetic construct
  REGION 1..120: note = >Tgex 207B7 huVH4_Q61A97A99T100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASARYTMDYWGQGTTVTVSS

SEQ ID NO: 374 - protein, 120 aa, synthetic construct
  REGION 1..120: note = >huVH4_Q61A97G99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFASGRYAMDYWGQGTTVTVSS

SEQ ID NO: 375 - protein, 120 aa, synthetic construct
  REGION 1..120: note = >Tgex 207B7 huVH4_Q61-CDRH3-4-5- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGHGRYALDYWGQGTTVTVSS

SEQ ID NO: 376 - protein, 120 aa, synthetic construct
  REGION 1..120: note = >huVH4_Q61G97A99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSARYAMDYWGQGTTVTVSS

SEQ ID NO: 377 - protein, 120 aa, synthetic construct
  REGION 1..120: note = >huVH4_Q61G97A99S104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSARYAMDYWSQGTTVTVSS

SEQ ID NO: 378 - protein, 120 aa, synthetic construct
  REGION 1..120: note = >huVH4_Q61G97G99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSGRYAMDYWGQGTTVTVSS

SEQ ID NO: 379 - protein, 120 aa, synthetic construct
  REGION 1..120: note = >huVH4_Q61G97G99S104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSGRYAMDYWSQGTTVTVSS

SEQ ID NO: 380 - protein, 121 aa, synthetic construct
  REGION 1..121: note = >Tgex 207B7 huVH4_Q61Q99ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSQSRYAMDYWGQGTTVTVSS

SEQ ID NO: 381 - protein, 120 aa, synthetic construct; identical to SEQ ID NO: 35
  REGION 1..120: note = >207B7-HuVH4_Q61

SEQ ID NO: 382 - protein, 120 aa, synthetic construct
  REGION 1..120: note = >Tgex 207B7 huVH4_Q61_CDRH3-10 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGSVRYTLDYWGQGTTVTVSS

SEQ ID NO: 383 - protein, 120 aa, synthetic construct
  REGION 1..120: note = >Tgex huVH4_Q61K97G98A99 sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGARYAMDYWGQGTTVTVSS

SEQ ID NO: 384 - protein, 120 aa, synthetic construct; identical to SEQ ID NO: 36
  REGION 1..120: note = >Tgex 207B7 huVH4_Q61K97G98G99 IgG1

SEQ ID NO: 385 - protein, 120 aa, synthetic construct
  REGION 1..120: note = >Tgex huVH4_Q61K97G98G99S100b sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGGRYSMDYWGQGTTVTVSS

SEQ ID NO: 386 - protein, 121 aa, synthetic construct
  REGION 1..121: note = >Tgex 207B7 huVH4_Q61K97ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGSSRYAMDYWGQGTTVTVSS

SEQ ID NO: 387 - protein, 122 aa, synthetic construct
  REGION 1..122: note = >Tgex 207B7 huVH4_Q61K97insQ98ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKQGSSRYAMDYWGQGTTVTVSS

SEQ ID NO: 388 - protein, 120 aa, synthetic construct
  REGION 1..120: note = >Tgex 207B7 huVH4_Q61K97G99L100c IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYALDYWGQGTTVTVSS

SEQ ID NO: 389 - protein, 120 aa, synthetic construct
  REGION 1..120: note = >huVH4_Q61K97G99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 390 - protein, 120 aa, synthetic construct
  REGION 1..120: note = >Tgex 207B7 huVH4_Q61K97G99D100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYDMDYWGQGTTVTVSS

SEQ ID NO: 391 - protein, 120 aa, synthetic construct
  REGION 1..120: note = >Tgex 207B7 huVH4_Q61K97G99E100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYEMDYWGQGTTVTVSS

SEQ ID NO: 392 - protein, 120 aa, synthetic construct
  REGION 1..120: note = >Tgex 207B7 huVH4_Q61K97G99S100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYSMDYWGQGTTVTVSS

SEQ ID NO: 393 - protein, 120 aa, synthetic construct
  REGION 1..120: note = >Tgex 207B7 huVH4_Q61K97G99T100b IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKSGRYTMDYWGQGTTVTVSS

SEQ ID NO: 394 - protein, 120 aa, synthetic construct
  REGION 1..120: note = >huVH4_Q61P97 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFPSSRYAMDYWGQGTTVTVSS

SEQ ID NO: 395 - protein, 121 aa, synthetic construct
  REGION 1..121: note = >Tgex 207B7 huVH4_Q61Q97ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFQGSSRYAMDYWGQGTTVTVSS

SEQ ID NO: 396 - protein, 122 aa, synthetic construct
  REGION 1..122: note = >Tgex 207B7 huVH4_Q61Q97insK98ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFQKGSSRYAMDYWGQGTTVTVSS

SEQ ID NO: 397 - protein, 120 aa, synthetic construct
  REGION 1..120: note = >huVH4_Q61Q97G99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFQSGRYAMDYWGQGTTVTVSS

SEQ ID NO: 398 - protein, 120 aa, synthetic construct
  REGION 1..120: note = >huVH4_Q61Q97 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFQSSRYAMDYWGQGTTVTVSS

SEQ ID NO: 399 - protein, 120 aa, synthetic construct
  REGION 1..120: note = >207B7-HuVH4_A98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRAGRYAMDYWGQGTTVTVSS

SEQ ID NO: 400 - protein, 120 aa, synthetic construct
  REGION 1..120: note = >207B7-HuVH4_D98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRDGRYAMDYWGQGTTVTVSS

SEQ ID NO: 401 - protein, 120 aa, synthetic construct
  REGION 1..120: note = >207B7-HuVH4_E98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFREGRYAMDYWGQGTTVTVSS

SEQ ID NO: 402 - protein, 120 aa, synthetic construct
  REGION 1..120: note = >207B7-HuVH4_F98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRFGRYAMDYWGQGTTVTVSS

SEQ ID NO: 403 - protein, 120 aa, synthetic construct
  REGION 1..120: note = >Tgex huVH4_Q61R97G98A99 sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRGARYAMDYWGQGTTVTVSS

SEQ ID NO: 404 - protein, 120 aa, synthetic construct
  REGION 1..120: note = >Tgex huVH4_Q61R97G98G99 sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRGGRYAMDYWGQGTTVTVSS

SEQ ID NO: 405 - protein, 120 aa, synthetic construct
  REGION 1..120: note = >Tgex huVH4_Q61R97G98G99S100b sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRGGRYSMDYWGQGTTVTVSS

SEQ ID NO: 406 - protein, 121 aa, synthetic construct
  REGION 1..121: note = >Tgex 207B7 huVH4_Q61R97ins- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRGSSRYAMDYWGQGTTVTVSS

SEQ ID NO: 407 - protein, 120 aa, synthetic construct
  REGION 1..120: note = >207B7-HuVH4_H98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRHGRYAMDYWGQGTTVTVSS

SEQ ID NO: 408 - protein, 120 aa, synthetic construct
  REGION 1..120: note = >207B7-HuVH4_I98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRIGRYAMDYWGQGTTVTVSS

SEQ ID NO: 409 - protein, 120 aa, synthetic construct
  REGION 1..120: note = >207B7-HuVH4_K98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRKGRYAMDYWGQGTTVTVSS

SEQ ID NO: 410 - protein, 120 aa, synthetic construct
  REGION 1..120: note = >207B7-HuVH4_L98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRLGRYAMDYWGQGTTVTVSS

SEQ ID NO: 411 - protein, 120 aa, synthetic construct
  REGION 1..120: note = >207B7-HuVH4_M98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRMGRYAMDYWGQGTTVTVSS

SEQ ID NO: 412 - protein, 120 aa, synthetic construct
  REGION 1..120: note = >207B7-HuVH4_N98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRNGRYAMDYWGQGTTVTVSS

SEQ ID NO: 413 - protein, 120 aa, synthetic construct
  REGION 1..120: note = >207B7-HuVH4_P98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRPGRYAMDYWGQGTTVTVSS

SEQ ID NO: 414 - protein, 120 aa, synthetic construct
  REGION 1..120: note = >207B7-HuVH4_Q98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRQGRYAMDYWGQGTTVTVSS

SEQ ID NO: 415 - protein, 120 aa, synthetic construct
  REGION 1..120: note = >207B7-HuVH4_QRGG-R98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRRGRYAMDYWGQGTTVTVSS

SEQ ID NO: 416 - protein, 120 aa, synthetic construct
  REGION 1..120: note = >huVH4_Q61R97A99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSARYAMDYWGQGTTVTVSS

SEQ ID NO: 417 - protein, 120 aa, synthetic construct
  REGION 1..120: note = >huVH4_Q61R97A99S104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSARYAMDYWSQGTTVTVSS

SEQ ID NO: 418 - protein, 120 aa, synthetic construct
  REGION 1..120: note = >huVH4_Q61R97G99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 419 - protein, 120 aa, synthetic construct
  REGION 1..120: note = >huVH4_Q61R97G99S104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRYAMDYWSQGTTVTVSS

SEQ ID NO: 420 - protein, 120 aa, synthetic construct
  REGION 1..120: note = >huVH4_Q61R97S99G104
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSSRYAMDYWGQGTTVTVSS

SEQ ID NO: 421 - protein, 120 aa, synthetic construct
  REGION 1..120: note = >207B7-HuVH4_T98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRTGRYAMDYWGQGTTVTVSS

SEQ ID NO: 422 - protein, 120 aa, synthetic construct
  REGION 1..120: note = >207B7-HuVH4_V98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRVGRYAMDYWGQGTTVTVSS

SEQ ID NO: 423 - protein, 120 aa, synthetic construct
  REGION 1..120: note = >207B7-HuVH4_W98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRWGRYAMDYWGQGTTVTVSS

SEQ ID NO: 424 - protein, 120 aa, synthetic construct
  REGION 1..120: note = >207B7-HuVH4_Y98
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRYGRYAMDYWGQGTTVTVSS

SEQ ID NO: 425 - protein, 120 aa, synthetic construct
  REGION 1..120: note = >Tgex 207B7 huVH4_Q61_CDRH3-22 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFYRNRYALDYWGQGTTVTVSS

SEQ ID NO: 426 - protein, 120 aa, synthetic construct
  REGION 1..120: note = >Tgex 207B7 huVH4_Q61-CDRH3-4-18- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGNGARYTLDYWGQGTTVTVSS

SEQ ID NO: 427 - protein, 120 aa, synthetic construct
  REGION 1..120: note = >Tgex 207B7 huVH4_Q61-CDRH3-4-20- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGNHARYSLDYWGQGTTVTVSS

SEQ ID NO: 428 - protein, 120 aa, synthetic construct
  REGION 1..120: note = >Tgex 207B7 huVH4_Q61-CDRH3-4-21- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGNYSRYSMDYWGQGTTVTVSS

SEQ ID NO: 429 - protein, 120 aa, synthetic construct
  REGION 1..120: note = >Tgex 207B7 huVH4_Q61-CDRH3-4-24- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGTHTRYAMDYWGQGTTVTVSS

SEQ ID NO: 430 - protein, 120 aa, synthetic construct
  REGION 1..120: note = >Tgex 207B7 huVH4_Q61-CDRH3-4-26- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGTNTRYAMDYWGQGTTVTVSS

SEQ ID NO: 431 - protein, 119 aa, synthetic construct
  REGION 1..119: note = >Tgex 207B7 huVH4_Q61CDRH3-7-30- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPARYAMDYWGQGTTVTVSS

SEQ ID NO: 432 - protein, 121 aa, synthetic construct
  REGION 1..121: note = >Tgex 207B7 huVH4_Q61CDRH3-7-39- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPHAARYAMDYWGQGTTVTVSS

SEQ ID NO: 433 - protein, 120 aa, synthetic construct
  REGION 1..120: note = >Tgex 207B7 huVH4_Q61-CDRH3-4-40- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPHARYSMDYWGQGTTVTVSS

SEQ ID NO: 434 - protein, 121 aa, synthetic construct
  REGION 1..121: note = >Tgex 207B7 huVH4_Q61CDRH3-7-41- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPHFIRYAMDYWGQGTTVTVSS

SEQ ID NO: 435 - protein, 120 aa, synthetic construct
  REGION 1..120: note = >Tgex 207B7 huVH4_Q61-CDRH3-4-46- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPHVRYEMDYWGQGTTVTVSS

SEQ ID NO: 436 - protein, 120 aa, synthetic construct
  REGION 1..120: note = >Tgex 207B7 huVH4_Q61-CDRH3-4-60- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPSGRYTMDYWGQGTTVTVSS

SEQ ID NO: 437 - protein, 120 aa, synthetic construct
  REGION 1..120: note = >Tgex 207B7 huVH4_Q61_CDRH3-38 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPSSRYAMDYWGQGTTVTVSS

SEQ ID NO: 438 - protein, 120 aa, synthetic construct
  REGION 1..120: note = >Tgex 207B7 huVH4_Q61_CDRH3-39 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPSTRYAMDYWGQGTTVTVSS

SEQ ID NO: 439 - protein, 119 aa, synthetic construct
  REGION 1..119: note = >Tgex 207B7 huVH4_Q61CDRH3-7-63- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPTRYAMDYWGQGTTVTVSS

SEQ ID NO: 440 - protein, 119 aa, synthetic construct
  REGION 1..119: note = >Tgex 207B7 huVH4_Q61CDRH3-7-64- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPVRYAMDYWGQGTTVTVSS

SEQ ID NO: 441 - protein, 120 aa, synthetic construct
  REGION 1..120: note = >Tgex 207B7 huVH4_Q61-CDRH3-4-76- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHTPVRYAMDYWGQGTTVTVSS

SEQ ID NO: 442 - protein, 120 aa, synthetic construct
  REGION 1..120: note = >Tgex huVH4_Q61K96A97P98T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKAPSRYTMDYWGQGTTVTVSS

SEQ ID NO: 443 - protein, 120 aa, synthetic construct
  REGION 1..120: note = >Tgex huVH4_Q61K96D97P98T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKDPSRYTMDYWGQGTTVTVSS

SEQ ID NO: 444 - protein, 120 aa, synthetic construct
  REGION 1..120: note = >Tgex huVH4_Q61K96G98T99sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGGTRYAMDYWGQGTTVTVSS

SEQ ID NO: 445 - protein, 120 aa, synthetic construct
  REGION 1..120: note = >Tgex 207B7 huVH4_Q61_CDRH3-42 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGLSRYAMDYWGQGTTVTVSS

SEQ ID NO: 446 - protein, 120 aa, synthetic construct
  REGION 1..120: note = >Tgex huVH4_Q61K96P98A99T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPARYTMDYWGQGTTVTVSS

SEQ ID NO: 447 - protein, 120 aa, synthetic construct
  REGION 1..120: note = >Tgex huVH4_Q61K96P98D99T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPDRYTMDYWGQGTTVTVSS

SEQ ID NO: 448 - protein, 120 aa, synthetic construct
  REGION 1..120: note = >Tgex huVH4_Q61K96P98G99T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPGRYTMDYWGQGTTVTVSS

SEQ ID NO: 449 - protein, 120 aa, synthetic construct
  REGION 1..120: note = >Tgex huVH4_Q61K96P98sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPSRYAMDYWGQGTTVTVSS

SEQ ID NO: 450 - protein, 120 aa, synthetic construct
  REGION 1..120: note = >Tgex huVH4_Q61K96P98D100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPSRYDMDYWGQGTTVTVSS

SEQ ID NO: 451 - protein, 120 aa, synthetic construct
  REGION 1..120: note = >Tgex huVH4_Q61K96P98S100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGPSRYSMDYWGQGTTVTVSS

SEQ ID NO: 452 - protein, 120 aa, synthetic construct; identical to SEQ ID NO: 37
  REGION 1..120: note = >Tgex 207B7 huVH4_Q61_CDRH3-43 IgG1

SEQ ID NO: 453 - protein, 120 aa, synthetic construct
  REGION 1..120: note = >Tgex 207B7 huVH4_Q61-CDRH3-44 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGRSRYAMDYWGQGTTVTVSS

SEQ ID NO: 454 - protein, 120 aa, synthetic construct
  REGION 1..120: note = >Tgex 207B7 huVH4_Q61K96 IgG1
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGSSRYAMDYWGQGTTVTVSS

SEQ ID NO: 455 - protein, 120 aa, synthetic construct
  REGION 1..120: note = >Tgex huVH4_Q61K96T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKGSSRYTMDYWGQGTTVTVSS

SEQ ID NO: 456 - protein, 120 aa, synthetic construct
  REGION 1..120: note = >Tgex huVH4_Q61_CDRH3-46sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKLSSRYAMDYWGQGTTVTVSS

SEQ ID NO: 457 - protein, 120 aa, synthetic construct
  REGION 1..120: note = >Tgex huVH4_Q61K96S97P98T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKSPSRYTMDYWGQGTTVTVSS

SEQ ID NO: 458 - protein, 120 aa, synthetic construct
  REGION 1..120: note = >Tgex 207B7 huVH4_Q61-CDRH3-4-80- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDMQHTRYSLDYWGQGTTVTVSS

SEQ ID NO: 459 - protein, 119 aa, synthetic construct
  REGION 1..119: note = >Tgex 207B7 huVH4_Q61CDRH3-7-82- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDNNHRYAMDYWGQGTTVTVSS

SEQ ID NO: 460 - protein, 120 aa, synthetic construct
  REGION 1..120: note = >Tgex 207B7 huVH4_Q61-CDRH3-4-84- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDPTSVRYALDYWGQGTTVTVSS

SEQ ID NO: 461 - protein, 120 aa, synthetic construct
  REGION 1..120: note = >huVH4_Q61Q96 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDQGSSRYAMDYWGQGTTVTVSS

SEQ ID NO: 462 - protein, 120 aa, synthetic construct
  REGION 1..120: note = >huVH4_Q61Q96P97A99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDQPSARYAMDYWGQGTTVTVSS

SEQ ID NO: 463 - protein, 120 aa, synthetic construct
  REGION 1..120: note = >huVH4_Q61Q96P97G99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDQPSGRYAMDYWGQGTTVTVSS

SEQ ID NO: 464 - protein, 120 aa, synthetic construct
  REGION 1..120: note = >huVH4_Q61Q96P97 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDQPSSRYAMDYWGQGTTVTVSS

SEQ ID NO: 465 - protein, 120 aa, synthetic construct
  REGION 1..120: note = >Tgex huVH4_Q61_CDRH3-58sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDRGGTRYAMDYWGQGTTVTVSS

SEQ ID NO: 466 - protein, 120 aa, synthetic construct
  REGION 1..120: note = >Tgex HuVH4_Q61R96P98T100bsil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDRGPSRYTMDYWGQGTTVTVSS

SEQ ID NO: 467 - protein, 120 aa, synthetic construct
  REGION 1..120: note = >Tgex huVH4_Q61R96L97sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDRLSSRYAMDYWGQGTTVTVSS

SEQ ID NO: 468 - protein, 120 aa, synthetic construct
  REGION 1..120: note = >huVH4_Q61S96A97A99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSASARYAMDYWGQGTTVTVSS

SEQ ID NO: 469 - protein, 120 aa, synthetic construct
  REGION 1..120: note = >huVH4_Q61S96G99 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSGSGRYAMDYWGQGTTVTVSS

SEQ ID NO: 470 - protein, 120 aa, synthetic construct
  REGION 1..120: note = >huVH4_Q61S96 Fab
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSGSSRYAMDYWGQGTTVTVSS

SEQ ID NO: 471 - protein, 120 aa, synthetic construct
  REGION 1..120: note = >Tgex 207B7 huVH4_Q61-CDRH3-4-90- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSPPVRYSLDYWGQGTTVTVSS

SEQ ID NO: 472 - protein, 120 aa, synthetic construct
  REGION 1..120: note = >Tgex 207B7 huVH4_Q61-CDRH3-4-92- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSYTSRYSLDYWGQGTTVTVSS

SEQ ID NO: 473 - protein, 120 aa, synthetic construct
  REGION 1..120: note = >Tgex 207B7 huVH4_Q61-CDRH3-4-96- sil (LALA_P331S)
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDWMQARYSLDYWGQGTTVTVSS

SEQ ID NO: 474 - protein, 120 aa, synthetic construct
  REGION 1..120: note = >Tgex huVH4_Q61T73K97G98G99 sil (LALA_P331S)
QVQLVQSGSELKKPGASVKVSCKASGYTFTSSGISWVRQAPGQGLEWMGEILPRSGYTNYNQGFTGRFVFSADTSVSTAYLQISSLKAEDTAVYYCARDFKGGRYAMDYWGQGTTVTVSS

SEQ ID NO: 475 - protein, 120 aa, synthetic construct
  REGION 1..120: note = >Tgex huVH4_Q61T73R97G98G99 sil (LALA_P331S)
QVQLVQSGSELKKPGASVKVSCKASGYTFTSSGISWVRQAPGQGLEWMGEILPRSGYTNYNQGFTGRFVFSADTSVSTAYLQISSLKAEDTAVYYCARDFRGGRYAMDYWGQGTTVTVSS

SEQ ID NO: 476 - protein, 120 aa, synthetic construct
  REGION 1..120: note = >Tgex huVH4_Q61T73_CDRH3-43 sil (LALA_P331S)
QVQLVQSGSELKKPGASVKVSCKASGYTFTSSGISWVRQAPGQGLEWMGEILPRSGYTNYNQGFTGRFVFSADTSVSTAYLQISSLKAEDTAVYYCARDKGPSRYTMDYWGQGTTVTVSS

SEQ ID NO: 477 - protein, 120 aa, synthetic construct
  REGION 1..120: note = >Tgex huVH4_Q61L71K97G98G99 sil (LALA_P331S)
QVQLVQSGSELKKPGASVKVSCKASGYTFTSSGISWVRQAPGQGLEWMGEILPRSGYTNYNQGFTGRFVFSLDKSVSTAYLQISSLKAEDTAVYYCARDFKGGRYAMDYWGQGTTVTVSS

SEQ ID NO: 478 - protein, 120 aa, synthetic construct
  REGION 1..120: note = >Tgex huVH4_Q61L71R97G98G99 sil (LALA_P331S)
QVQLVQSGSELKKPGASVKVSCKASGYTFTSSGISWVRQAPGQGLEWMGEILPRSGYTNYNQGFTGRFVFSLDKSVSTAYLQISSLKAEDTAVYYCARDFRGGRYAMDYWGQGTTVTVSS

SEQ ID NO: 479 - protein, 120 aa, synthetic construct
  REGION 1..120: note = >Tgex huVH4_Q61L71_CDRH3-43 sil (LALA_P331S)
QVQLVQSGSELKKPGASVKVSCKASGYTFTSSGISWVRQAPGQGLEWMGEILPRSGYTNYNQGFTGRFVFSLDKSVSTAYLQISSLKAEDTAVYYCARDKGPSRYTMDYWGQGTTVTVSS

SEQ ID NO: 480 - protein, 120 aa, synthetic construct
  REGION 1..120: note = >huVH4-QRGG_L69S75
QVQLVQSGSELKKPGASVKVSCKASGYTFTSSGISWVRQAPGQGLEWMGEILPRSGYTNYNQGFTGRFVLSADKSSSTAYLQISSLKAEDTAVYYCARDFRSGRYAMDYWGQGTTVTVSS

SEQ ID NO: 481 - protein, 120 aa, synthetic construct
  REGION 1..120: note = >huVH4-QRGG_L69F91
QVQLVQSGSELKKPGASVKVSCKASGYTFTSSGISWVRQAPGQGLEWMGEILPRSGYTNYNQGFTGRFVLSADKSVSTAYLQISSLKAEDTAVYFCARDFRSGRYAMDYWGQGTTVTVSS

SEQ ID NO: 482 - protein, 120 aa, synthetic construct
  REGION 1..120: note = >huVH4-QRGG_L69
QVQLVQSGSELKKPGASVKVSCKASGYTFTSSGISWVRQAPGQGLEWMGEILPRSGYTNYNQGFTGRFVLSADKSVSTAYLQISSLKAEDTAVYYCARDFRSGRYAMDYWGQGTTVTVSS

SEQ ID NO: 483 - protein, 120 aa, synthetic construct
  REGION 1..120: note = >Tgex 207B7 huVH4_Q61K62E64A97A99 IgG1
QVQLVQSGSELKKPGASVKVSCKASGYTFTSSGISWVRQAPGQGLEWMGEILPRSGYTNYNQKFEGRFVFSADKSVSTAYLQISSLKAEDTAVYYCARDFASARYAMDYWGQGTTVTVSS

SEQ ID NO: 484 - protein, 120 aa, synthetic construct
  REGION 1..120: note = >Tgex 207B7 huVH4_Q61K62E64K97G99 IgG1
QVQLVQSGSELKKPGASVKVSCKASGYTFTSSGISWVRQAPGQGLEWMGEILPRSGYTNYNQKFEGRFVFSADKSVSTAYLQISSLKAEDTAVYYCARDFKSGRYAMDYWGQGTTVTVSS

SEQ ID NO: 485 - protein, 120 aa, synthetic construct
  REGION 1..120: note = >huVH4_Q61K62E64R97G99 Fab
QVQLVQSGSELKKPGASVKVSCKASGYTFTSSGISWVRQAPGQGLEWMGEILPRSGYTNYNQKFEGRFVFSADKSVSTAYLQISSLKAEDTAVYYCARDFRSGRYAMDYWGQGTTVTVSS

SEQ ID NO: 486 - protein, 120 aa, synthetic construct
  REGION 1..120: note = >Tgex 207B7 huVH4_Q61K62K64K97G99 IgG1
QVQLVQSGSELKKPGASVKVSCKASGYTFTSSGISWVRQAPGQGLEWMGEILPRSGYTNYNQKFKGRFVFSADKSVSTAYLQISSLKAEDTAVYYCARDFKSGRYAMDYWGQGTTVTVSS

SEQ ID NO: 487 - protein, 120 aa, synthetic construct
  REGION 1..120: note = >Tgex 207B7 huVH4_Q61K62Q64K97G99 IgG1
QVQLVQSGSELKKPGASVKVSCKASGYTFTSSGISWVRQAPGQGLEWMGEILPRSGYTNYNQKFQGRFVFSADKSVSTAYLQISSLKAEDTAVYYCARDFKSGRYAMDYWGQGTTVTVSS

SEQ ID NO: 488 - protein, 120 aa, synthetic construct
  REGION 1..120: note = >Tgex 207B7 huVH4_Q61K62A97A99 IgG1
QVQLVQSGSELKKPGASVKVSCKASGYTFTSSGISWVRQAPGQGLEWMGEILPRSGYTNYNQKFTGRFVFSADKSVSTAYLQISSLKAEDTAVYYCARDFASARYAMDYWGQGTTVTVSS

SEQ ID NO: 489 - protein, 120 aa, synthetic construct
  REGION 1..120: note = >huVH4_Q61K62K97G99 IgG
QVQLVQSGSELKKPGASVKVSCKASGYTFTSSGISWVRQAPGQGLEWMGEILPRSGYTNYNQKFTGRFVFSADKSVSTAYLQISSLKAEDTAVYYCARDFKSGRYAMDYWGQGTTVTVSS

SEQ ID NO: 490 - protein, 120 aa, synthetic construct
  REGION 1..120: note = >huVH4_Q61W62K97G99 IgG
QVQLVQSGSELKKPGASVKVSCKASGYTFTSSGISWVRQAPGQGLEWMGEILPRSGYTNYNQWFTGRFVFSADKSVSTAYLQISSLKAEDTAVYYCARDFKSGRYAMDYWGQGTTVTVSS

SEQ ID NO: 491 - protein, 120 aa, synthetic construct
  REGION 1..120: note = >207B7-HuVH4_R61
QVQLVQSGSELKKPGASVKVSCKASGYTFTSSGISWVRQAPGQGLEWMGEILPRSGYTNYNRGFTGRFVFSADKSVSTAYLQISSLKAEDTAVYYCARDFGSSRYAMDYWGQGTTVTVSS

SEQ ID NO: 492 - protein, 120 aa, synthetic construct
  REGION 1..120: note = >207B7-HuVH4_S61
QVQLVQSGSELKKPGASVKVSCKASGYTFTSSGISWVRQAPGQGLEWMGEILPRSGYTNYNSGFTGRFVFSADKSVSTAYLQISSLKAEDTAVYYCARDFGSSRYAMDYWGQGTTVTVSS

SEQ ID NO: 493 - protein, 120 aa, synthetic construct
  REGION 1..120: note = >207B7-HuVH4_T61
QVQLVQSGSELKKPGASVKVSCKASGYTFTSSGISWVRQAPGQGLEWMGEILPRSGYTNYNTGFTGRFVFSADKSVSTAYLQISSLKAEDTAVYYCARDFGSSRYAMDYWGQGTTVTVSS

SEQ ID NO: 494 - protein, 120 aa, synthetic construct
  REGION 1..120: note = >207B7-HuVH4_V61
QVQLVQSGSELKKPGASVKVSCKASGYTFTSSGISWVRQAPGQGLEWMGEILPRSGYTNYNVGFTGRFVFSADKSVSTAYLQISSLKAEDTAVYYCARDFGSSRYAMDYWGQGTTVTVSS

SEQ ID NO: 495 - protein, 120 aa, synthetic construct
  REGION 1..120: note = >207B7-HuVH4_W61
QVQLVQSGSELKKPGASVKVSCKASGYTFTSSGISWVRQAPGQGLEWMGEILPRSGYTNYNWGFTGRFVFSADKSVSTAYLQISSLKAEDTAVYYCARDFGSSRYAMDYWGQGTTVTVSS

SEQ ID NO: 496 - protein, 120 aa, synthetic construct
  REGION 1..120: note = >207B7-HuVH4_Y61
QVQLVQSGSELKKPGASVKVSCKASGYTFTSSGISWVRQAPGQGLEWMGEILPRSGYTNYNYGFTGRFVFSADKSVSTAYLQISSLKAEDTAVYYCARDFGSSRYAMDYWGQGTTVTVSS

SEQ ID NO: 497 - protein, 120 aa, synthetic construct
  REGION 1..120: note = >Tgex 207B7 huVH4_S58Q61-CDRH3-4-1- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDAGHARYTMDYWGQGTTVTVSS

SEQ ID NO: 498 - protein, 120 aa, synthetic construct
  REGION 1..120: note = >Tgex 207B7 huVH4_S58Q61-CDRH3-4-5- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFGHGRYALDYWGQGTTVTVSS

SEQ ID NO: 499 - protein, 121 aa, synthetic construct
  REGION 1..121: note = >Tgex 207B7 huVH4_S58Q61Q99ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFGSQSRYAMDYWGQGTTVTVSS

SEQ ID NO: 500 - protein, 120 aa, synthetic construct
  REGION 1..120: note = >Tgex 207B7 huVH4_S58Q61K97G98G99- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFKGGRYAMDYWGQGTTVTVSS

SEQ ID NO: 501 - protein, 121 aa, synthetic construct
  REGION 1..121: note = >Tgex 207B7 huVH4_S58Q61K97ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFKGSSRYAMDYWGQGTTVTVSS

SEQ ID NO: 502 - protein, 122 aa, synthetic construct
  REGION 1..122: note = >Tgex 207B7 huVH4_S58Q61K97insQ98ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFKQGSSRYAMDYWGQGTTVTVSS

SEQ ID NO: 503 - protein, 121 aa, synthetic construct
  REGION 1..121: note = >Tgex 207B7 huVH4_S58Q61Q97ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFQGSSRYAMDYWGQGTTVTVSS

SEQ ID NO: 504 - protein, 122 aa, synthetic construct
  REGION 1..122: note = >Tgex 207B7 huVH4_S58Q61Q97insK98ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFQKGSSRYAMDYWGQGTTVTVSS

SEQ ID NO: 505 - protein, 121 aa, synthetic construct
  REGION 1..121: note = >Tgex 207B7 huVH4_S58Q61R97ins- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDFRGSSRYAMDYWGQGTTVTVSS

SEQ ID NO: 506 - protein, 120 aa, synthetic construct
  REGION 1..120: note = >Tgex 207B7 huVH4_S58Q61-CDRH3-4-18- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDGNGARYTLDYWGQGTTVTVSS

SEQ ID NO: 507 - protein, 120 aa, synthetic construct
  REGION 1..120: note = >Tgex 207B7 huVH4_S58Q61-CDRH3-4-20- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDGNHARYSLDYWGQGTTVTVSS

SEQ ID NO: 508 - protein, 120 aa, synthetic construct
  REGION 1..120: note = >Tgex 207B7 huVH4_S58Q61-CDRH3-4-21- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDGNYSRYSMDYWGQGTTVTVSS

SEQ ID NO: 509 - protein, 120 aa, synthetic construct
  REGION 1..120: note = >Tgex 207B7 huVH4_S58Q61-CDRH3-4-24- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDGTHTRYAMDYWGQGTTVTVSS

SEQ ID NO: 510 - protein, 120 aa, synthetic construct
  REGION 1..120: note = >Tgex 207B7 huVH4_S58Q61-CDRH3-4-26- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDGTNTRYAMDYWGQGTTVTVSS

SEQ ID NO: 511 - protein, 119 aa, synthetic construct
  REGION 1..119: note = >Tgex 207B7 huVH4_S58Q61CDRH3-7-30- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPARYAMDYWGQGTTVTVSS

SEQ ID NO: 512 - protein, 121 aa, synthetic construct
  REGION 1..121: note = >Tgex 207B7 huVH4_S58Q61CDRH3-7-39- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPHAARYAMDYWGQGTTVTVSS

SEQ ID NO: 513 - protein, 120 aa, synthetic construct
  REGION 1..120: note = >Tgex 207B7 huVH4_S58Q61-CDRH3-4-40- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPHARYSMDYWGQGTTVTVSS

SEQ ID NO: 514 - protein, 121 aa, synthetic construct
  REGION 1..121: note = >Tgex 207B7 huVH4_S58Q61CDRH3-7-41- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPHFIRYAMDYWGQGTTVTVSS

SEQ ID NO: 515 - protein, 120 aa, synthetic construct
  REGION 1..120: note = >Tgex 207B7 huVH4_S58Q61-CDRH3-4-46- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPHVRYEMDYWGQGTTVTVSS

SEQ ID NO: 516 - protein, 120 aa, synthetic construct
  REGION 1..120: note = >Tgex 207B7 huVH4_S58Q61-CDRH3-4-60- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPSGRYTMDYWGQGTTVTVSS

SEQ ID NO: 517 - protein, 119 aa, synthetic construct
  REGION 1..119: note = >Tgex 207B7 huVH4_S58Q61CDRH3-7-63- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPTRYAMDYWGQGTTVTVSS

SEQ ID NO: 518 - protein, 119 aa, synthetic construct
  REGION 1..119: note = >Tgex 207B7 huVH4_S58Q61CDRH3-7-64- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHPVRYAMDYWGQGTTVTVSS

SEQ ID NO: 519 - protein, 120 aa, synthetic construct
  REGION 1..120: note = >Tgex 207B7 huVH4_S58Q61-CDRH3-4-76- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDHTPVRYAMDYWGQGTTVTVSS

SEQ ID NO: 520 - protein, 120 aa, synthetic construct
  REGION 1..120: note = >Tgex 207B7 huVH4_S58Q61KPA99T- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDKGPARYTMDYWGQGTTVTVSS

SEQ ID NO: 521 - protein, 120 aa, synthetic construct
  REGION 1..120: note = >Tgex 207B7 huVH4_S58Q61-CDRH3-43- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDKGPSRYTMDYWGQGTTVTVSS

SEQ ID NO: 522 - protein, 120 aa, synthetic construct
  REGION 1..120: note = >Tgex 207B7 huVH4_S58Q61-CDRH3-4-80- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDMQHTRYSLDYWGQGTTVTVSS

SEQ ID NO: 523 - protein, 119 aa, synthetic construct
  REGION 1..119: note = >Tgex 207B7 huVH4_S58Q61CDRH3-7-82- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDNNHRYAMDYWGQGTTVTVSS

SEQ ID NO: 524 - protein, 120 aa, synthetic construct
  REGION 1..120: note = >Tgex 207B7 huVH4_S58Q61-CDRH3-4-84- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDPTSVRYALDYWGQGTTVTVSS

SEQ ID NO: 525 - protein, 120 aa, synthetic construct
  REGION 1..120: note = >Tgex 207B7 huVH4_S58Q61-CDRH3-4-90- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDSPPVRYSLDYWGQGTTVTVSS

SEQ ID NO: 526 - protein, 120 aa, synthetic construct
  REGION 1..120: note = >Tgex 207B7 huVH4_S58Q61-CDRH3-4-92- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDSYTSRYSLDYWGQGTTVTVSS

SEQ ID NO: 527 - protein, 120 aa, synthetic construct
  REGION 1..120: note = >Tgex 207B7 huVH4_S58Q61-CDRH3-4-96- sil (LALA_P331S)
QVQLVQSGSELKKPGASVKVSCKASGYTFTSSGISWVRQAPGQGLEWMGEILPRSGYTSYNQGFTGRFVFSADKSVSTAYLQISSLKAEDTAVYYCARDWMQARYSLDYWGQGTTVTVSS

SEQ ID NO: 528 - protein, 120 aa, synthetic construct
  REGION 1..120: note = >Tgex 207B7 huVH4_T58Q61A97A99 IgG1
QVQLVQSGSELKKPGASVKVSCKASGYTFTSSGISWVRQAPGQGLEWMGEILPRSGYTTYNQGFTGRFVFSADKSVSTAYLQISSLKAEDTAVYYCARDFASARYAMDYWGQGTTVTVSS

SEQ ID NO: 529 - protein, 120 aa, synthetic construct
  REGION 1..120: note = >Tgex 207B7 huVH4_N55Q61A97A99 IgG1
QVQLVQSGSELKKPGASVKVSCKASGYTFTSSGISWVRQAPGQGLEWMGEILPRSNYTNYNQGFTGRFVFSADKSVSTAYLQISSLKAEDTAVYYCARDFASARYAMDYWGQGTTVTVSS

SEQ ID NO: 530 - protein, 120 aa, synthetic construct
  REGION 1..120: note = >Tgex 207B7 huVH4_R55Q61A97A99 IgG1
QVQLVQSGSELKKPGASVKVSCKASGYTFTSSGISWVRQAPGQGLEWMGEILPRSRYTNYNQGFTGRFVFSADKSVSTAYLQISSLKAEDTAVYYCARDFASARYAMDYWGQGTTVTVSS

SEQ ID NO: 531 - protein, 120 aa, synthetic construct
  REGION 1..120: note = >Tgex 207B7 huVH4_S55Q61A97A99 IgG1
QVQLVQSGSELKKPGASVKVSCKASGYTFTSSGISWVRQAPGQGLEWMGEILPRSSYTNYNQGFTGRFVFSADKSVSTAYLQISSLKAEDTAVYYCARDFASARYAMDYWGQGTTVTVSS

SEQ ID NO: 532 - protein, 120 aa, synthetic construct
  REGION 1..120: note = >Tgex huVH4_S55Q61K97G98G99 sil (LALA_P331S)
QVQLVQSGSELKKPGASVKVSCKASGYTFTSSGISWVRQAPGQGLEWMGEILPRSSYTNYNQGFTGRFVFSADKSVSTAYLQISSLKAEDTAVYYCARDFKGGRYAMDYWGQGTTVTVSS

SEQ ID NO: 533 - protein, 120 aa, synthetic construct
  REGION 1..120: note = >Tgex huVH4_S55Q61R97G98G99 sil (LALA_P331S)
QVQLVQSGSELKKPGASVKVSCKASGYTFTSSGISWVRQAPGQGLEWMGEILPRSSYTNYNQGFTGRFVFSADKSVSTAYLQISSLKAEDTAVYYCARDFRGGRYAMDYWGQGTTVTVSS

SEQ ID NO: 534 - protein, 120 aa, synthetic construct
  REGION 1..120: note = >Tgex huVH4_S55Q61_CDRH3-43sil (LALA_P331S)
QVQLVQSGSELKKPGASVKVSCKASGYTFTSSGISWVRQAPGQGLEWMGEILPRSSYTNYNQGFTGRFVFSADKSVSTAYLQISSLKAEDTAVYYCARDKGPSRYTMDYWGQGTTVTVSS

SEQ ID NO: 535 - protein, 120 aa, synthetic construct
  REGION 1..120: note = >Tgex 207B7 huVH4_T55Q61A97A99 IgG1
QVQLVQSGSELKKPGASVKVSCKASGYTFTSSGISWVRQAPGQGLEWMGEILPRSTYTNYNQGFTGRFVFSADKSVSTAYLQISSLKAEDTAVYYCARDFASARYAMDYWGQGTTVTVSS

SEQ ID NO: 536 - protein, 120 aa, synthetic construct
  REGION 1..120: note = >Tgex huVH4_T55Q61_CDRH3-43sil (LALA_P331S)
QVQLVQSGSELKKPGASVKVSCKASGYTFTSSGISWVRQAPGQGLEWMGEILPRSTYTNYNQGFTGRFVFSADKSVSTAYLQISSLKAEDTAVYYCARDKGPSRYTMDYWGQGTTVTVSS

SEQ ID NO: 537 - protein, 120 aa, synthetic construct
  REGION 1..120: note = >Tgex 207B7 huVH4_W55Q61A97A99 IgG1
QVQLVQSGSELKKPGASVKVSCKASGYTFTSSGISWVRQAPGQGLEWMGEILPRSWYTNYNQGFTGRFVFSADKSVSTAYLQISSLKAEDTAVYYCARDFASARYAMDYWGQGTTVTVSS

SEQ ID NO: 538 - protein, 120 aa, synthetic construct
  REGION 1..120: note = >Tgex 207B7 huVH4_Y55Q61A97A99 IgG1
QVQLVQSGSELKKPGASVKVSCKASGYTFTSSGISWVRQAPGQGLEWMGEILPRSYYTNYNQGFTGRFVFSADKSVSTAYLQISSLKAEDTAVYYCARDFASARYAMDYWGQGTTVTVSS

SEQ ID NO: 539 - protein, 120 aa, synthetic construct
  REGION 1..120: note = >Tgex 207B7 huVH4_T54Q61A97A99 IgG1
QVQLVQSGSELKKPGASVKVSCKASGYTFTSSGISWVRQAPGQGLEWMGEILPRTGYTNYNQGFTGRFVFSADKSVSTAYLQISSLKAEDTAVYYCARDFASARYAMDYWGQGTTVTVSS

SEQ ID NO: 540 - protein, 120 aa, synthetic construct
  REGION 1..120: note = >Tgex 207B7 huVH4_S53Q61A97A99 IgG1
QVQLVQSGSELKKPGASVKVSCKASGYTFTSSGISWVRQAPGQGLEWMGEILPSSGYTNYNQGFTGRFVFSADKSVSTAYLQISSLKAEDTAVYYCARDFASARYAMDYWGQGTTVTVSS

SEQ ID NO: 541 - protein, 120 aa, synthetic construct
  REGION 1..120: note = >Tgex 207B7 huVH4_T53Q61A97A99 IgG1
QVQLVQSGSELKKPGASVKVSCKASGYTFTSSGISWVRQAPGQGLEWMGEILPTSGYTNYNQGFTGRFVFSADKSVSTAYLQISSLKAEDTAVYYCARDFASARYAMDYWGQGTTVTVSS

SEQ ID NO: 542 - protein, 120 aa, synthetic construct
  REGION 1..120: note = >Tgex 207B7 huVH4_W53Q61A97A99 IgG1
QVQLVQSGSELKKPGASVKVSCKASGYTFTSSGISWVRQAPGQGLEWMGEILPWSGYTNYNQGFTGRFVFSADKSVSTAYLQISSLKAEDTAVYYCARDFASARYAMDYWGQGTTVTVSS

SEQ ID NO: 543 - protein, 120 aa, synthetic construct
  REGION 1..120: note = >huVH4_W53Q61R97G99 Fab
QVQLVQSGSELKKPGASVKVSCKASGYTFTSSGISWVRQAPGQGLEWMGEILPWSGYTNYNQGFTGRFVFSADKSVSTAYLQISSLKAEDTAVYYCARDFRSGRYAMDYWGQGTTVTVSS

SEQ ID NO: 544 - protein, 120 aa, synthetic construct
  REGION 1..120: note = >Tgex 207B7 huVH4_Y53Q61A97A99 IgG1
QVQLVQSGSELKKPGASVKVSCKASGYTFTSSGISWVRQAPGQGLEWMGEILPYSGYTNYNQGFTGRFVFSADKSVSTAYLQISSLKAEDTAVYYCARDFASARYAMDYWGQGTTVTVSS

SEQ ID NO: 545 - protein, 120 aa, synthetic construct
  REGION 1..120: note = >Tgex 207B7 huVH4_Q52aQ61A97A99 IgG1
QVQLVQSGSELKKPGASVKVSCKASGYTFTSSGISWVRQAPGQGLEWMGEILQRSGYTNYNQGFTGRFVFSADKSVSTAYLQISSLKAEDTAVYYCARDFASARYAMDYWGQGTTVTVSS

SEQ ID NO: 546 - protein, 120 aa, synthetic construct
  REGION 1..120: note = >Tgex 207B7 huVH4_S52aQ61A97A99 IgG1
QVQLVQSGSELKKPGASVKVSCKASGYTFTSSGISWVRQAPGQGLEWMGEILSRSGYTNYNQGFTGRFVFSADKSVSTAYLQISSLKAEDTAVYYCARDFASARYAMDYWGQGTTVTVSS

SEQ ID NO: 547 - protein, 120 aa, synthetic construct
  REGION 1..120: note = >Tgex 207B7 huVH4_T52aQ61A97A99 IgG1
QVQLVQSGSELKKPGASVKVSCKASGYTFTSSGISWVRQAPGQGLEWMGEILTRSGYTNYNQGFTGRFVFSADKSVSTAYLQISSLKAEDTAVYYCARDFASARYAMDYWGQGTTVTVSS

SEQ ID NO: 548 - protein, 120 aa, synthetic construct
  REGION 1..120: note = >Tgex 207B7 huVH4_W52aQ61A97A99 IgG1
QVQLVQSGSELKKPGASVKVSCKASGYTFTSSGISWVRQAPGQGLEWMGEILWRSGYTNYNQGFTGRFVFSADKSVSTAYLQISSLKAEDTAVYYCARDFASARYAMDYWGQGTTVTVSS

SEQ ID NO: 549 - protein, 120 aa, synthetic construct
  REGION 1..120: note = >Tgex 207B7 huVH4_Y52aQ61A97A99 IgG1
QVQLVQSGSELKKPGASVKVSCKASGYTFTSSGISWVRQAPGQGLEWMGEILYRSGYTNYNQGFTGRFVFSADKSVSTAYLQISSLKAEDTAVYYCARDFASARYAMDYWGQGTTVTVSS

SEQ ID NO: 550 - protein, 120 aa, synthetic construct
  REGION 1..120: note = >huVH4_N52Q61R97G99 Fab
QVQLVQSGSELKKPGASVKVSCKASGYTFTSSGISWVRQAPGQGLEWMGEINPRSGYTNYNQGFTGRFVFSADKSVSTAYLQISSLKAEDTAVYYCARDFRSGRYAMDYWGQGTTVTVSS

SEQ ID NO: 551 - protein, 120 aa, synthetic construct
  REGION 1..120: note = >Tgex 207B7 huVH4_Q52H58Q61-CDRH3-4-1- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDAGHARYTMDYWGQGTTVTVSS

SEQ ID NO: 552 - protein, 120 aa, synthetic construct
  REGION 1..120: note = >Tgex 207B7 huVH4_Q52H58Q61-CDRH3-4-5- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFGHGRYALDYWGQGTTVTVSS

SEQ ID NO: 553 - protein, 121 aa, synthetic construct
  REGION 1..121: note = >Tgex 207B7 huVH4_Q52H58Q61Q99ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFGSQSRYAMDYWGQGTTVTVSS

SEQ ID NO: 554 - protein, 120 aa, synthetic construct
  REGION 1..120: note = >Tgex 207B7 huVH4_Q52H58Q61K97G98G99- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFKGGRYAMDYWGQGTTVTVSS

SEQ ID NO: 555 - protein, 121 aa, synthetic construct
  REGION 1..121: note = >Tgex 207B7 huVH4_Q52H58Q61K97ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFKGSSRYAMDYWGQGTTVTVSS

SEQ ID NO: 556 - protein, 122 aa, synthetic construct
  REGION 1..122: note = >Tgex 207B7 huVH4_Q52H58Q61K97insQ98ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFKQGSSRYAMDYWGQGTTVTVSS

SEQ ID NO: 557 - protein, 121 aa, synthetic construct
  REGION 1..121: note = >Tgex 207B7 huVH4_Q52H58Q61Q97ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFQGSSRYAMDYWGQGTTVTVSS

SEQ ID NO: 558 - protein, 122 aa, synthetic construct
  REGION 1..122: note = >Tgex 207B7 huVH4_Q52H58Q61Q97insK98ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFQKGSSRYAMDYWGQGTTVTVSS

SEQ ID NO: 559 - protein, 121 aa, synthetic construct
  REGION 1..121: note = >Tgex 207B7 huVH4_Q52H58Q61R97ins- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDFRGSSRYAMDYWGQGTTVTVSS

SEQ ID NO: 560 - protein, 120 aa, synthetic construct
  REGION 1..120: note = >Tgex 207B7 huVH4_Q52H58Q61-CDRH3-4-18- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDGNGARYTLDYWGQGTTVTVSS

SEQ ID NO: 561 - protein, 120 aa, synthetic construct
  REGION 1..120: note = >Tgex 207B7 huVH4_Q52H58Q61-CDRH3-4-20- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDGNHARYSLDYWGQGTTVTVSS

SEQ ID NO: 562 - protein, 120 aa, synthetic construct
  REGION 1..120: note = >Tgex 207B7 huVH4_Q52H58Q61-CDRH3-4-21- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDGNYSRYSMDYWGQGTTVTVSS

SEQ ID NO: 563 - protein, 120 aa, synthetic construct
  REGION 1..120: note = >Tgex 207B7 huVH4_Q52H58Q61-CDRH3-4-24- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDGTHTRYAMDYWGQGTTVTVSS

SEQ ID NO: 564 - protein, 120 aa, synthetic construct
  REGION 1..120: note = >Tgex 207B7 huVH4_Q52H58Q61-CDRH3-4-26- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDGTNTRYAMDYWGQGTTVTVSS

SEQ ID NO: 565 - protein, 119 aa, synthetic construct
  REGION 1..119: note = >Tgex 207B7 huVH4_Q52H58Q61CDRH3-7-30- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPARYAMDYWGQGTTVTVSS

SEQ ID NO: 566 - protein, 121 aa, synthetic construct
  REGION 1..121: note = >Tgex 207B7 huVH4_Q52H58Q61CDRH3-7-39- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPHAARYAMDYWGQGTTVTVSS

SEQ ID NO: 567 - protein, 120 aa, synthetic construct
  REGION 1..120: note = >Tgex 207B7 huVH4_Q52H58Q61-CDRH3-4-40- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPHARYSMDYWGQGTTVTVSS

SEQ ID NO: 568 - protein, 121 aa, synthetic construct
  REGION 1..121: note = >Tgex 207B7 huVH4_Q52H58Q61CDRH3-7-41- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPHFIRYAMDYWGQGTTVTVSS

SEQ ID NO: 569 - protein, 120 aa, synthetic construct
  REGION 1..120: note = >Tgex 207B7 huVH4_Q52H58Q61-CDRH3-4-46- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPHVRYEMDYWGQGTTVTVSS

SEQ ID NO: 570 - protein, 120 aa, synthetic construct
  REGION 1..120: note = >Tgex 207B7 huVH4_Q52H58Q61-CDRH3-4-60- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPSGRYTMDYWGQGTTVTVSS

SEQ ID NO: 571 - protein, 119 aa, synthetic construct
  REGION 1..119: note = >Tgex 207B7 huVH4_Q52H58Q61CDRH3-7-63- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPTRYAMDYWGQGTTVTVSS

SEQ ID NO: 572 - protein, 119 aa, synthetic construct
  REGION 1..119: note = >Tgex 207B7 huVH4_Q52H58Q61CDRH3-7-64- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHPVRYAMDYWGQGTTVTVSS

SEQ ID NO: 573 - protein, 120 aa, synthetic construct
  REGION 1..120: note = >Tgex 207B7 huVH4_Q52H58Q61-CDRH3-4-76- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDHTPVRYAMDYWGQGTTVTVSS

SEQ ID NO: 574 - protein, 120 aa, synthetic construct
  REGION 1..120: note = >Tgex 207B7 huVH4_Q52H58Q61KPA99T- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDKGPARYTMDYWGQGTTVTVSS

SEQ ID NO: 575 - protein, 120 aa, synthetic construct
  REGION 1..120: note = >Tgex 207B7 huVH4_Q52H58Q61-CDRH3-43- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDKGPSRYTMDYWGQGTTVTVSS

SEQ ID NO: 576 - protein, 120 aa, synthetic construct
  REGION 1..120: note = >Tgex 207B7 huVH4_Q52H58Q61-CDRH3-4-80- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDMQHTRYSLDYWGQGTTVTVSS

SEQ ID NO: 577 - protein, 119 aa, synthetic construct
  REGION 1..119: note = >Tgex 207B7 huVH4_Q52H58Q61CDRH3-7-82- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDNNHRYAMDYWGQGTTVTVSS

SEQ ID NO: 578 - protein, 120 aa, synthetic construct
  REGION 1..120: note = >Tgex 207B7 huVH4_Q52H58Q61-CDRH3-4-84- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDPTSVRYALDYWGQGTTVTVSS

SEQ ID NO: 579 - protein, 120 aa, synthetic construct
  REGION 1..120: note = >Tgex 207B7 huVH4_Q52H58Q61-CDRH3-4-90- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDSPPVRYSLDYWGQGTTVTVSS

SEQ ID NO: 580 - protein, 120 aa, synthetic construct
  REGION 1..120: note = >Tgex 207B7 huVH4_Q52H58Q61-CDRH3-4-92- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDSYTSRYSLDYWGQGTTVTVSS

SEQ ID NO: 581 - protein, 120 aa, synthetic construct
  REGION 1..120: note = >Tgex 207B7 huVH4_Q52H58Q61-CDRH3-4-96- sil (LALA_P331S)
QVQLVQSGSELKKPGASVKVSCKASGYTFTSSGISWVRQAPGQGLEWMGEIQPRSGYTHYNQGFTGRFVFSADKSVSTAYLQISSLKAEDTAVYYCARDWMQARYSLDYWGQGTTVTVSS

SEQ ID NO: 582 - protein, 120 aa, synthetic construct
  REGION 1..120: note = >Tgex 207B7 huVH4_Q52Q61-CDRH3-4-1- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDAGHARYTMDYWGQGTTVTVSS

SEQ ID NO: 583 - protein, 120 aa, synthetic construct
  REGION 1..120: note = >Tgex 207B7 huVH4_Q52Q61-CDRH3-4-5- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFGHGRYALDYWGQGTTVTVSS

SEQ ID NO: 584 - protein, 121 aa, synthetic construct
  REGION 1..121: note = >Tgex 207B7 huVH4_Q52Q61Q99ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFGSQSRYAMDYWGQGTTVTVSS

SEQ ID NO: 585 - protein, 120 aa, synthetic construct
  REGION 1..120: note = >Tgex 207B7 huVH4_Q52Q61K97G98G99- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFKGGRYAMDYWGQGTTVTVSS

SEQ ID NO: 586 - protein, 121 aa, synthetic construct
  REGION 1..121: note = >Tgex 207B7 huVH4_Q52Q61K97ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFKGSSRYAMDYWGQGTTVTVSS

SEQ ID NO: 587 - protein, 122 aa, synthetic construct
  REGION 1..122: note = >Tgex 207B7 huVH4_Q52Q61K97insQ98ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFKQGSSRYAMDYWGQGTTVTVSS

SEQ ID NO: 588 - protein, 121 aa, synthetic construct
  REGION 1..121: note = >Tgex 207B7 huVH4_Q52Q61Q97ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFQGSSRYAMDYWGQGTTVTVSS

SEQ ID NO: 589 - protein, 122 aa, synthetic construct
  REGION 1..122: note = >Tgex 207B7 huVH4_Q52Q61Q97insK98ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFQKGSSRYAMDYWGQGTTVTVSS

SEQ ID NO: 590 - protein, 121 aa, synthetic construct
  REGION 1..121: note = >Tgex 207B7 huVH4_Q52Q61R97ins- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDFRGSSRYAMDYWGQGTTVTVSS

SEQ ID NO: 591 - protein, 120 aa, synthetic construct
  REGION 1..120: note = >Tgex 207B7 huVH4_Q52Q61-CDRH3-4-18- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDGNGARYTLDYWGQGTTVTVSS

SEQ ID NO: 592 - protein, 120 aa, synthetic construct
  REGION 1..120: note = >Tgex 207B7 huVH4_Q52Q61-CDRH3-4-20- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDGNHARYSLDYWGQGTTVTVSS

SEQ ID NO: 593 - protein, 120 aa, synthetic construct
  REGION 1..120: note = >Tgex 207B7 huVH4_Q52Q61-CDRH3-4-21- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDGNYSRYSMDYWGQGTTVTVSS

SEQ ID NO: 594 - protein, 120 aa, synthetic construct
  REGION 1..120: note = >Tgex 207B7 huVH4_Q52Q61-CDRH3-4-24- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDGTHTRYAMDYWGQGTTVTVSS

SEQ ID NO: 595 - protein, 120 aa, synthetic construct
  REGION 1..120: note = >Tgex 207B7 huVH4_Q52Q61-CDRH3-4-26- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDGTNTRYAMDYWGQGTTVTVSS

SEQ ID NO: 596 - protein, 119 aa, synthetic construct
  REGION 1..119: note = >Tgex 207B7 huVH4_Q52Q61CDRH3-7-30- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPARYAMDYWGQGTTVTVSS

SEQ ID NO: 597 - protein, 121 aa, synthetic construct
  REGION 1..121: note = >Tgex 207B7 huVH4_Q52Q61CDRH3-7-39- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPHAARYAMDYWGQGTTVTVSS

SEQ ID NO: 598 - protein, 120 aa, synthetic construct
  REGION 1..120: note = >Tgex 207B7 huVH4_Q52Q61-CDRH3-4-40- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPHARYSMDYWGQGTTVTVSS

SEQ ID NO: 599 - protein, 121 aa, synthetic construct
  REGION 1..121: note = >Tgex 207B7 huVH4_Q52Q61CDRH3-7-41- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPHFIRYAMDYWGQGTTVTVSS

SEQ ID NO: 600 - protein, 120 aa, synthetic construct
  REGION 1..120: note = >Tgex 207B7 huVH4_Q52Q61-CDRH3-4-46- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPHVRYEMDYWGQGTTVTVSS

SEQ ID NO: 601 - protein, 120 aa, synthetic construct
  REGION 1..120: note = >Tgex 207B7 huVH4_Q52Q61-CDRH3-4-60- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPSGRYTMDYWGQGTTVTVSS

SEQ ID NO: 602 - protein, 119 aa, synthetic construct
  REGION 1..119: note = >Tgex 207B7 huVH4_Q52Q61CDRH3-7-63- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPTRYAMDYWGQGTTVTVSS

SEQ ID NO: 603 - protein, 119 aa, synthetic construct
  REGION 1..119: note = >Tgex 207B7 huVH4_Q52Q61CDRH3-7-64- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHPVRYAMDYWGQGTTVTVSS

SEQ ID NO: 604 - protein, 120 aa, synthetic construct
  REGION 1..120: note = >Tgex 207B7 huVH4_Q52Q61-CDRH3-4-76- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDHTPVRYAMDYWGQGTTVTVSS

SEQ ID NO: 605 - protein, 120 aa, synthetic construct; identical to SEQ ID NO: 102
  REGION 1..120: note = >Tgex 207B7 huVH4_Q52Q61KPA99T- sil (LALA_P331S)

SEQ ID NO: 606 - protein, 120 aa, synthetic construct
  REGION 1..120: note = >Tgex 207B7 huVH4_Q52Q61-CDRH3-43- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDKGPSRYTMDYWGQGTTVTVSS

SEQ ID NO: 607 - protein, 120 aa, synthetic construct
  REGION 1..120: note = >Tgex 207B7 huVH4_Q52Q61-CDRH3-4-80- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDMQHTRYSLDYWGQGTTVTVSS

SEQ ID NO: 608 - protein, 119 aa, synthetic construct
  REGION 1..119: note = >Tgex 207B7 huVH4_Q52Q61CDRH3-7-82- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDNNHRYAMDYWGQGTTVTVSS

SEQ ID NO: 609 - protein, 120 aa, synthetic construct
  REGION 1..120: note = >Tgex 207B7 huVH4_Q52Q61-CDRH3-4-84- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDPTSVRYALDYWGQGTTVTVSS

SEQ ID NO: 610 - protein, 120 aa, synthetic construct
  REGION 1..120: note = >Tgex 207B7 huVH4_Q52Q61-CDRH3-4-90- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDSPPVRYSLDYWGQGTTVTVSS

SEQ ID NO: 611 - protein, 120 aa, synthetic construct
  REGION 1..120: note = >Tgex 207B7 huVH4_Q52Q61-CDRH3-4-92- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDSYTSRYSLDYWGQGTTVTVSS

SEQ ID NO: 612 - protein, 120 aa, synthetic construct
  REGION 1..120: note = >Tgex 207B7 huVH4_Q52Q61-CDRH3-4-96- sil (LALA_P331S)
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDWMQARYSLDYWGQGTTVTVSS

SEQ ID NO: 613 - protein, 120 aa, synthetic construct
  REGION 1..120: note = >Tgex 207B7 huVH4_Q52S58Q61-CDRH3-4-1- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDAGHARYTMDYWGQGTTVTVSS

SEQ ID NO: 614 - protein, 120 aa, synthetic construct
  REGION 1..120: note = >Tgex 207B7 huVH4_Q52S58Q61-CDRH3-4-5- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFGHGRYALDYWGQGTTVTVSS

SEQ ID NO: 615 - protein, 121 aa, synthetic construct
  REGION 1..121: note = Artificial Sequence
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFGSQSRYAMDYWGQGTTVTVSS

SEQ ID NO: 616 - protein, 120 aa, synthetic construct
  REGION 1..120: note = >Tgex 207B7 huVH4_Q52S58Q61K97G98G99- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFKGGRYAMDYWGQGTTVTVSS

SEQ ID NO: 617 - protein, 121 aa, synthetic construct
  REGION 1..121: note = >Tgex 207B7 huVH4_Q52S58Q61K97ins- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFKGSSRYAMDYWGQGTTVTVSS

SEQ ID NO: 618 - protein, 122 aa, synthetic construct
  REGION 1..122: note = >Tgex 207B7 huVH4_Q52S58Q61K97insQ98ins- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFKQGSSRYAMDYWGQGTTVTVSS

SEQ ID NO: 619 - protein, 121 aa, synthetic construct
  REGION 1..121: note = >Tgex 207B7 huVH4_Q52S58Q61Q97ins- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFQGSSRYAMDYWGQGTTVTVSS

SEQ ID NO: 620 - protein, 122 aa, synthetic construct
  REGION 1..122: note = >Tgex 207B7 huVH4_Q52S58Q61Q97insK98ins- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFQKGSSRYAMDYWGQGTTVTVSS

SEQ ID NO: 621 - protein, 121 aa, synthetic construct
  REGION 1..121: note = >Tgex 207B7 huVH4_Q52S58Q61R97ins- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDFRGSSRYAMDYWGQGTTVTVSS

SEQ ID NO: 622 - protein, 120 aa, synthetic construct
  REGION 1..120: note = >Tgex 207B7 huVH4_Q52S58Q61-CDRH3-4-18- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDGNGARYTLDYWGQGTTVTVSS

SEQ ID NO: 623 - protein, 120 aa, synthetic construct
  REGION 1..120: note = >Tgex 207B7 huVH4_Q52S58Q61-CDRH3-4-20- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDGNHARYSLDYWGQGTTVTVSS

SEQ ID NO: 624 - protein, 120 aa, synthetic construct
  REGION 1..120: note = >Tgex 207B7 huVH4_Q52S58Q61-CDRH3-4-21- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDGNYSRYSMDYWGQGTTVTVSS

SEQ ID NO: 625 - protein, 120 aa, synthetic construct
  REGION 1..120: note = >Tgex 207B7 huVH4_Q52S58Q61-CDRH3-4-24- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDGTHTRYAMDYWGQGTTVTVSS

SEQ ID NO: 626 - protein, 120 aa, synthetic construct
  REGION 1..120: note = >Tgex 207B7 huVH4_Q52S58Q61-CDRH3-4-26- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDGTNTRYAMDYWGQGTTVTVSS

SEQ ID NO: 627 - protein, 119 aa, synthetic construct
  REGION 1..119: note = >Tgex 207B7 huVH4_Q52S58Q61CDRH3-7-30- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPARYAMDYWGQGTTVTVSS

SEQ ID NO: 628 - protein, 121 aa, synthetic construct
  REGION 1..121: note = >Tgex 207B7 huVH4_Q52S58Q61CDRH3-7-39- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPHAARYAMDYWGQGTTVTVSS

SEQ ID NO: 629 - protein, 120 aa, synthetic construct
  REGION 1..120: note = >Tgex 207B7 huVH4_Q52S58Q61-CDRH3-4-40- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPHARYSMDYWGQGTTVTVSS

SEQ ID NO: 630 - protein, 121 aa, synthetic construct
  REGION 1..121: note = >Tgex 207B7 huVH4_Q52S58Q61CDRH3-7-41- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPHFIRYAMDYWGQGTTVTVSS

SEQ ID NO: 631 - protein, 120 aa, synthetic construct
  REGION 1..120: note = >Tgex 207B7 huVH4_Q52S58Q61-CDRH3-4-46- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPHVRYEMDYWGQGTTVTVSS

SEQ ID NO: 632 - protein, 120 aa, synthetic construct
  REGION 1..120: note = >Tgex 207B7 huVH4_Q52S58Q61-CDRH3-4-60- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPSGRYTMDYWGQGTTVTVSS

SEQ ID NO: 633 - protein, 119 aa, synthetic construct
  REGION 1..119: note = >Tgex 207B7 huVH4_Q52S58Q61CDRH3-7-63- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPTRYAMDYWGQGTTVTVSS

SEQ ID NO: 634 - protein, 119 aa, synthetic construct
  REGION 1..119: note = >Tgex 207B7 huVH4_Q52S58Q61CDRH3-7-64- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHPVRYAMDYWGQGTTVTVSS

SEQ ID NO: 635 - protein, 120 aa, synthetic construct
  REGION 1..120: note = >Tgex 207B7 huVH4_Q52S58Q61-CDRH3-4-76- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDHTPVRYAMDYWGQGTTVTVSS

SEQ ID NO: 636 - protein, 120 aa, synthetic construct
  REGION 1..120: note = >Tgex 207B7 huVH4_Q52S58Q61KPA99T- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDKGPARYTMDYWGQGTTVTVSS

SEQ ID NO: 637 - protein, 120 aa, synthetic construct
  REGION 1..120: note = >Tgex 207B7 huVH4_Q52S58Q61-CDRH3-43- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDKGPSRYTMDYWGQGTTVTVSS

SEQ ID NO: 638 - protein, 120 aa, synthetic construct
  REGION 1..120: note = >Tgex 207B7 huVH4_Q52S58Q61-CDRH3-4-80- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDMQHTRYSLDYWGQGTTVTVSS

SEQ ID NO: 639 - protein, 119 aa, synthetic construct
  REGION 1..119: note = >Tgex 207B7 huVH4_Q52S58Q61CDRH3-7-82- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDNNHRYAMDYWGQGTTVTVSS

SEQ ID NO: 640 - protein, 120 aa, synthetic construct
  REGION 1..120: note = >Tgex 207B7 huVH4_Q52S58Q61-CDRH3-4-84- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDPTSVRYALDYWGQGTTVTVSS

SEQ ID NO: 641 - protein, 120 aa, synthetic construct
  REGION 1..120: note = >Tgex 207B7 huVH4_Q52S58Q61-CDRH3-4-90- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDSPPVRYSLDYWGQGTTVTVSS

SEQ ID NO: 642 - protein, 120 aa, synthetic construct
  REGION 1..120: note = >Tgex 207B7 huVH4_Q52S58Q61-CDRH3-4-92- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDSYTSRYSLDYWGQGTTVTVSS

SEQ ID NO: 643 - protein, 120 aa, synthetic construct
  REGION 1..120: note = >Tgex 207B7 huVH4_Q52S58Q61-CDRH3-4-96- sil (LALA_P331S)
QVQLVQSGSELKKPGASVKVSCKASGYTFTSSGISWVRQAPGQGLEWMGEIQPRSGYTSYNQGFTGRFVFSADKSVSTAYLQISSLKAEDTAVYYCARDWMQARYSLDYWGQGTTVTVSS

SEQ ID NO: 644 - protein, 120 aa, synthetic construct
  REGION 1..120: note = >Tgex 207B7 huVH4_W50Q61A97A99 IgG1
QVQLVQSGSELKKPGASVKVSCKASGYTFTSSGISWVRQAPGQGLEWMGWILPRSGYTNYNQGFTGRFVFSADKSVSTAYLQISSLKAEDTAVYYCARDFASARYAMDYWGQGTTVTVSS

SEQ ID NO: 645 - protein, 120 aa, synthetic construct
  REGION 1..120: note = >HuVH4-QRGG_M34
QVQLVQSGSELKKPGASVKVSCKASGYTFTSSGMSWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 646 - protein, 120 aa, synthetic construct
  REGION 1..120: note = >huVH4_T32Q35Q61K97G99 IgG
QVQLVQSGSELKKPGASVKVSCKASGYTFTSTGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 647 - protein, 120 aa, synthetic construct
  REGION 1..120: note = >huVH4_T32Q61A62K97G99 IgG
QVQLVQSGSELKKPGASVKVSCKASGYTFTSTGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 648 - protein, 120 aa, synthetic construct
  REGION 1..120: note = >huVH4_T32Q61K97G99 IgG
QVQLVQSGSELKKPGASVKVSCKASGYTFTSTGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 649 - protein, 120 aa, synthetic construct
  REGION 1..120: note = >HuVH4-QRGG_Y32A33N35
QVQLVQSGSELKKPGASVKVSCKASGYTFTSYAINWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 650 - protein, 120 aa, synthetic construct
  REGION 1..120: note = >HuVH4-QRGG_CDR1germ
QVQLVQSGSELKKPGASVKVSCKASGYTFTSYAMNWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 651 - protein, 120 aa, synthetic construct
  REGION 1..120: note = >Tgex VH-IGHV7-4-1*02 IgG1
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARDFGSSRYAMDYWGQGTTVTVSS

SEQ ID NO: 652 - protein, 120 aa, synthetic construct
  REGION 1..120: note = >HuVH4-QRGG_Y32N35
QVQLVQSGSELKKPGASVKVSCKASGYTFTSYGINWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 653 - protein, 120 aa, synthetic construct
  REGION 1..120: note = >HuVH4-QRGG_Y32
QVQLVQSGSELKKPGASVKVSCKASGYTFTSYGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 654 - protein, 120 aa, synthetic construct
  REGION 1..120: note = >huVH4_T31H32Q35Q61A62K97G99 IgG
QVQLVQSGSELKKPGASVKVSCKASGYTFTTHGIQWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 655 - protein, 120 aa, synthetic construct
  REGION 1..120: note = >huVH4_T31H32Q35Q61K97G99 IgG
QVQLVQSGSELKKPGASVKVSCKASGYTFTTHGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 656 - protein, 120 aa, synthetic construct
  REGION 1..120: note = >huVH4_T31R32Q61K97G99 IgG
QVQLVQSGSELKKPGASVKVSCKASGYTFTTRGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 657 - protein, 120 aa, synthetic construct
  REGION 1..120: note = >huVH4_T31Q35Q61K97G99 IgG
QVQLVQSGSELKKPGASVKVSCKASGYTFTTSGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 658 - protein, 120 aa, synthetic construct
  REGION 1..120: note = >huVH4_T31Q61A62K97G99 IgG
QVQLVQSGSELKKPGASVKVSCKASGYTFTTSGISWVRQAPGQGLEWMGEILPRSGYTNYNQAFTGRFVFSADKSVSTAYLQISSLKAEDTAVYYCARDFKSGRYAMDYWGQGTTVTVSS

SEQ ID NO: 659 - protein, 120 aa, synthetic construct
  REGION 1..120: note = >huVH4_T31Q61K97G99 IgG
QVQLVQSGSELKKPGASVKVSCKASGYTFTTSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 660 - protein, 120 aa, synthetic construct
  REGION 1..120: note = >huVH4_T31T32Q35Q61K97G99 IgG
QVQLVQSGSELKKPGASVKVSCKASGYTFTTTGIQWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 661 - protein, 120 aa, synthetic construct
  REGION 1..120: note = >huVH4_T31T32Q61K97G99 IgG
QVQLVQSGSELKKPGASVKVSCKASGYTFTTTGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 662 - protein, 120 aa, synthetic construct
  REGION 1..120: note = >Tgex 207B7 huVH4_Y30Q61A97A99 IgG1
QVQLVQSGSELKKPGASVKVSCKASGYTFYSSGISWVRQAPGQGLEWMGEILPRSGYTNYNQGFTGRFVFSADKSVSTAYLQISSLKAEDTAVYYCARDFASARYAMDYWGQGTTVTVSS

SEQ ID NO: 663 - protein, 120 aa, synthetic construct
  REGION 1..120: note = >huVH4_Y30Q61K97G99 Fab
QVQLVQSGSELKKPGASVKVSCKASGYTFYSSGISWVRQAPGQGLEWMGEILPRSGYTNYNQGFTGRFVFSADKSVSTAYLQISSLKAEDTAVYYCARDFKSGRYAMDYWGQGTTVTVSS

SEQ ID NO: 664 - protein, 120 aa, synthetic construct
  REGION 1..120: note = >Tgex 207B7 huVH4_Y30Q61K62E64K97G99 IgG1
QVQLVQSGSELKKPGASVKVSCKASGYTFYSSGISWVRQAPGQGLEWMGEILPRSGYTNYNQKFEGRFVFSADKSVSTAYLQISSLKAEDTAVYYCARDFKSGRYAMDYWGQGTTVTVSS

SEQ ID NO: 665 - protein, 120 aa, synthetic construct
  REGION 1..120: note = >Tgex 207B7 huVH4_Y30Q61K62K97G99 IgG1
QVQLVQSGSELKKPGASVKVSCKASGYTFYSSGISWVRQAPGQGLEWMGEILPRSGYTNYNQKFTGRFVFSADKSVSTAYLQISSLKAEDTAVYYCARDFKSGRYAMDYWGQGTTVTVSS

SEQ ID NO: 666 - protein, 107 aa, synthetic construct
  REGION 1..107: note = >Hu-VL3_G24H90S93
SIQMTQSPSSLSASVGDRVTITCGASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 667 - protein, 107 aa, synthetic construct
  REGION 1..107: note = >Hu-VL3_K24H90S93
SIQMTQSPSSLSASVGDRVTITCKASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 668 - protein, 107 aa, synthetic construct
  REGION 1..107: note = >Hu-VL3_D26H90S93
SIQMTQSPSSLSASVGDRVTITCQADQSVRYNVAWYQQKPGKAPKLLIYYASNRYTGVPSRFSGSGSGTDFTFTISSLQPEDIATYFCQHHYSSPLTFGGGTKLEIK

SEQ ID NO: 669 - protein, 107 aa, synthetic construct
  REGION 1..107: note = >Hu-VL3_G26H90S93
SIQMTQSPSSLSASVGDRVTITCQAGQSVRYNVAWYQQKPGKAPKLLIYYASNRYTGVPSRFSGSGSGTDFTFTISSLQPEDIATYFCQHHYSSPLTFGGGTKLEIK

SEQ ID NO: 670 - protein, 107 aa, synthetic construct
  REGION 1..107: note = >Hu-VL3_N26H90S93
SIQMTQSPSSLSASVGDRVTITCQANQSVRYNVAWYQQKPGKAPKLLIYYASNRYTGVPSRFSGSGSGTDFTFTISSLQPEDIATYFCQHHYSSPLTFGGGTKLEIK

SEQ ID NO: 671 - protein, 107 aa, synthetic construct
  REGION 1..107: note = >HuVL3_H90S93_S28D
SIQMTQSPSSLSASVGDRVTITCQASQDVRYNVAWYQQKPGKAPKLLIYYASNRYTGVPSRFSGSGSGTDFTFTISSLQPEDIATYFCQHHYSSPLTFGGGTKLEIK

SEQ ID NO: 672 - protein, 107 aa, synthetic construct
  REGION 1..107: note = >Hu-VL3_G28H90S93
SIQMTQSPSSLSASVGDRVTITCQASQGVRYNVAWYQQKPGKAPKLLIYYASNRYTGVPSRFSGSGSGTDFTFTISSLQPEDIATYFCQHHYSSPLTFGGGTKLEIK

SEQ ID NO: 673 - protein, 107 aa, synthetic construct
  REGION 1..107: note = >Hu-VL3_H28H90S93
SIQMTQSPSSLSASVGDRVTITCQASQHVRYNVAWYQQKPGKAPKLLIYYASNRYTGVPSRFSGSGSGTDFTFTISSLQPEDIATYFCQHHYSSPLTFGGGTKLEIK

SEQ ID NO: 674 - protein, 107 aa, synthetic construct
  REGION 1..107: note = >Hu-VL3_I28H90S93
SIQMTQSPSSLSASVGDRVTITCQASQIVRYNVAWYQQKPGKAPKLLIYYASNRYTGVPSRFSGSGSGTDFTFTISSLQPEDIATYFCQHHYSSPLTFGGGTKLEIK

SEQ ID NO: 675 - protein, 107 aa, synthetic construct
  REGION 1..107: note = >Hu-VL3_L28H90S93
SIQMTQSPSSLSASVGDRVTITCQASQLVRYNVAWYQQKPGKAPKLLIYYASNRYTGVPSRFSGSGSGTDFTFTISSLQPEDIATYFCQHHYSSPLTFGGGTKLEIK

SEQ ID NO: 676 - protein, 107 aa, synthetic construct
  REGION 1..107: note = >Hu-VL3_N28H90S93
SIQMTQSPSSLSASVGDRVTITCQASQNVRYNVAWYQQKPGKAPKLLIYYASNRYTGVPSRFSGSGSGTDFTFTISSLQPEDIATYFCQHHYSSPLTFGGGTKLEIK

SEQ ID NO: 677 - protein, 107 aa, synthetic construct
  REGION 1..107: note = >Hu-VL3_A29H90S93
SIQMTQSPSSLSASVGDRVTITCQASQSARYNVAWYQQKPGKAPKLLIYYASNRYTGVPSRFSGSGSGTDFTFTISSLQPEDIATYFCQHHYSSPLTFGGGTKLEIK

SEQ ID NO: 678 - protein, 107 aa, synthetic construct
  REGION 1..107: note = >Hu-VL3_D29H90S93
SIQMTQSPSSLSASVGDRVTITCQASQSDRYNVAWYQQKPGKAPKLLIYYASNRYTGVPSRFSGSGSGTDFTFTISSLQPEDIATYFCQHHYSSPLTFGGGTKLEIK

SEQ ID NO: 679 - protein, 107 aa, synthetic construct
  REGION 1..107: note = >Hu-VL3_G29H90S93
SIQMTQSPSSLSASVGDRVTITCQASQSGRYNVAWYQQKPGKAPKLLIYYASNRYTGVPSRFSGSGSGTDFTFTISSLQPEDIATYFCQHHYSSPLTFGGGTKLEIK

SEQ ID NO: 680 - protein, 107 aa, synthetic construct
  REGION 1..107: note = >Tgex 207B7huVL3_I29M33D56H90S93
SIQMTQSPSSLSASVGDRVTITCQASQSIRYNMAWYQQKPGKAPKLLIYYASNRYDGVPSRFSGSGSGTDFTFTISSLQPEDIATYFCQHHYSSPLTFGGGTKLEIK

SEQ ID NO: 681 - protein, 107 aa, synthetic construct
  REGION 1..107: note = >Tgex 207B7huVL3_I29M33D56Y87H90S93
SIQMTQSPSSLSASVGDRVTITCQASQSIRYNMAWYQQKPGKAPKLLIYYASNRYDGVPSRFSGSGSGTDFTFTISSLQPEDIATYYCQHHYSSPLTFGGGTKLEIK

SEQ ID NO: 682 - protein, 107 aa, synthetic construct
  REGION 1..107: note = >Tgex 207B7huVL3_I29M33E56H90S93
SIQMTQSPSSLSASVGDRVTITCQASQSIRYNMAWYQQKPGKAPKLLIYYASNRYEGVPSRFSGSGSGTDFTFTISSLQPEDIATYFCQHHYSSPLTFGGGTKLEIK

SEQ ID NO: 683 - protein, 107 aa, synthetic construct
  REGION 1..107: note = >Tgex 207B7huVL3_I29M33E56Y87H90S93
SIQMTQSPSSLSASVGDRVTITCQASQSIRYNMAWYQQKPGKAPKLLIYYASNRYEGVPSRFSGSGSGTDFTFTISSLQPEDIATYYCQHHYSSPLTFGGGTKLEIK

SEQ ID NO: 684 - protein, 107 aa, synthetic construct
  REGION 1..107: note = >Tgex 207B7huVL3_I29M33H90S93
SIQMTQSPSSLSASVGDRVTITCQASQSIRYNMAWYQQKPGKAPKLLIYYASNRYTGVPSRFSGSGSGTDFTFTISSLQPEDIATYFCQHHYSSPLTFGGGTKLEIK

SEQ ID NO: 685 - protein, 107 aa, synthetic construct
  REGION 1..107: note = >Tgex 207B7huVL3_I29M33Y87H90S93
SIQMTQSPSSLSASVGDRVTITCQASQSIRYNMAWYQQKPGKAPKLLIYYASNRYTGVPSRFSGSGSGTDFTFTISSLQPEDIATYYCQHHYSSPLTFGGGTKLEIK

SEQ ID NO: 686 - protein, 107 aa, synthetic construct
  REGION 1..107: note = >Tgex 207B7 huVL3_I29M33G34D56H90S93
SIQMTQSPSSLSASVGDRVTITCQASQSIRYNMGWYQQKPGKAPKLLIYYASNRYDGVPSRFSGSGSGTDFTFTISSLQPEDIATYFCQHHYSSPLTFGGGTKLEIK

SEQ ID NO: 687 - protein, 107 aa, synthetic construct
  REGION 1..107: note = >Tgex 207B7 huVL3_I29M33G34D56Y87H90S93
SIQMTQSPSSLSASVGDRVTITCQASQSIRYNMGWYQQKPGKAPKLLIYYASNRYDGVPSRFSGSGSGTDFTFTISSLQPEDIATYYCQHHYSSPLTFGGGTKLEIK

SEQ ID NO: 688 - protein, 107 aa, synthetic construct
  REGION 1..107: note = >Tgex 207B7huVL3_I29M33G34E56H90S93
SIQMTQSPSSLSASVGDRVTITCQASQSIRYNMGWYQQKPGKAPKLLIYYASNRYEGVPSRFSGSGSGTDFTFTISSLQPEDIATYFCQHHYSSPLTFGGGTKLEIK

SEQ ID NO: 689 - protein, 107 aa, synthetic construct
  REGION 1..107: note = >Tgex 207B7huVL3_I29M33G34E56Y87H90S93
SIQMTQSPSSLSASVGDRVTITCQASQSIRYNMGWYQQKPGKAPKLLIYYASNRYEGVPSRFSGSGSGTDFTFTISSLQPEDIATYYCQHHYSSPLTFGGGTKLEIK

SEQ ID NO: 690 - protein, 107 aa, synthetic construct
  REGION 1..107: note = >Tgex 207B7huVL3_I29M33G34H90S93
SIQMTQSPSSLSASVGDRVTITCQASQSIRYNMGWYQQKPGKAPKLLIYYASNRYTGVPSRFSGSGSGTDFTFTISSLQPEDIATYFCQHHYSSPLTFGGGTKLEIK

SEQ ID NO: 691 - protein, 107 aa, synthetic construct
  REGION 1..107: note = >Tgex 207B7huVL3_I29M33G34Y87H90S93
SIQMTQSPSSLSASVGDRVTITCQASQSIRYNMGWYQQKPGKAPKLLIYYASNRYTGVPSRFSGSGSGTDFTFTISSLQPEDIATYYCQHHYSSPLTFGGGTKLEIK

SEQ ID NO: 692 - protein, 107 aa, synthetic construct
  REGION 1..107: note = >Tgex 207B7huVL3_I29D56H90S93
SIQMTQSPSSLSASVGDRVTITCQASQSIRYNVAWYQQKPGKAPKLLIYYASNRYDGVPSRFSGSGSGTDFTFTISSLQPEDIATYFCQHHYSSPLTFGGGTKLEIK

SEQ ID NO: 693 - protein, 107 aa, synthetic construct
  REGION 1..107: note = >Tgex 207B7huVL3_I29D56Y87H90S93
SIQMTQSPSSLSASVGDRVTITCQASQSIRYNVAWYQQKPGKAPKLLIYYASNRYDGVPSRFSGSGSGTDFTFTISSLQPEDIATYYCQHHYSSPLTFGGGTKLEIK

SEQ ID NO: 694 - protein, 107 aa, synthetic construct
  REGION 1..107: note = >Tgex 207B7huVL3_I29E56H90S93
SIQMTQSPSSLSASVGDRVTITCQASQSIRYNVAWYQQKPGKAPKLLIYYASNRYEGVPSRFSGSGSGTDFTFTISSLQPEDIATYFCQHHYSSPLTFGGGTKLEIK

SEQ ID NO: 695 - protein, 107 aa, synthetic construct; identical to SEQ ID NO: 104
  REGION 1..107: note = >Tgex 207B7huVL3_I29E56Y87H90S93

SEQ ID NO: 696 - protein, 107 aa, synthetic construct
  REGION 1..107: note = >HuVL3_H90S93_V29I
SIQMTQSPSSLSASVGDRVTITCQASQSIRYNVAWYQQKPGKAPKLLIYYASNRYTGVPSRFSGSGSGTDFTFTISSLQPEDIATYFCQHHYSSPLTFGGGTKLEIK

SEQ ID NO: 697 - protein, 107 aa, synthetic construct
  REGION 1..107: note = >Tgex 207B7huVL3_I29Y87H90S93
SIQMTQSPSSLSASVGDRVTITCQASQSIRYNVAWYQQKPGKAPKLLIYYASNRYTGVPSRFSGSGSGTDFTFTISSLQPEDIATYYCQHHYSSPLTFGGGTKLEIK

SEQ ID NO: 698 - protein, 107 aa, synthetic construct
  REGION 1..107: note = >Tgex 207B7huVL3_I29G34D56H90S93
SIQMTQSPSSLSASVGDRVTITCQASQSIRYNVGWYQQKPGKAPKLLIYYASNRYDGVPSRFSGSGSGTDFTFTISSLQPEDIATYFCQHHYSSPLTFGGGTKLEIK

SEQ ID NO: 699 - protein, 107 aa, synthetic construct
  REGION 1..107: note = >Tgex 207B7huVL3_I29G34D56Y87H90S93
SIQMTQSPSSLSASVGDRVTITCQASQSIRYNVGWYQQKPGKAPKLLIYYASNRYDGVPSRFSGSGSGTDFTFTISSLQPEDIATYYCQHHYSSPLTFGGGTKLEIK

SEQ ID NO: 700 - protein, 107 aa, synthetic construct
  REGION 1..107: note = >Tgex 207B7huVL3_I29G34E56H90S93
SIQMTQSPSSLSASVGDRVTITCQASQSIRYNVGWYQQKPGKAPKLLIYYASNRYEGVPSRFSGSGSGTDFTFTISSLQPEDIATYFCQHHYSSPLTFGGGTKLEIK

SEQ ID NO: 701 - protein, 107 aa, synthetic construct
  REGION 1..107: note = >Tgex 207B7huVL3_I29G34E56Y87H90S93
SIQMTQSPSSLSASVGDRVTITCQASQSIRYNVGWYQQKPGKAPKLLIYYASNRYEGVPSRFSGSGSGTDFTFTISSLQPEDIATYYCQHHYSSPLTFGGGTKLEIK

SEQ ID NO: 702 - protein, 107 aa, synthetic construct
  REGION 1..107: note = >Tgex 207B7huVL3_I29G34H90S93
SIQMTQSPSSLSASVGDRVTITCQASQSIRYNVGWYQQKPGKAPKLLIYYASNRYTGVPSRFSGSGSGTDFTFTISSLQPEDIATYFCQHHYSSPLTFGGGTKLEIK

SEQ ID NO: 703 - protein, 107 aa, synthetic construct
  REGION 1..107: note = >Tgex 207B7huVL3_I29G34Y87H90S93
SIQMTQSPSSLSASVGDRVTITCQASQSIRYNVGWYQQKPGKAPKLLIYYASNRYTGVPSRFSGSGSGTDFTFTISSLQPEDIATYYCQHHYSSPLTFGGGTKLEIK

SEQ ID NO: 704 - protein, 107 aa, synthetic construct
  REGION 1..107: note = >Hu-VL3_N29H90S93
SIQMTQSPSSLSASVGDRVTITCQASQSNRYNVAWYQQKPGKAPKLLIYYASNRYTGVPSRFSGSGSGTDFTFTISSLQPEDIATYFCQHHYSSPLTFGGGTKLEIK

SEQ ID NO: 705 - protein, 107 aa, synthetic construct
  REGION 1..107: note = >Hu-VL3_P29H90S93
SIQMTQSPSSLSASVGDRVTITCQASQSPRYNVAWYQQKPGKAPKLLIYYASNRYTGVPSRFSGSGSGTDFTFTISSLQPEDIATYFCQHHYSSPLTFGGGTKLEIK

SEQ ID NO: 706 - protein, 107 aa, synthetic construct
  REGION 1..107: note = >Hu-VL3_Q29H90S93
SIQMTQSPSSLSASVGDRVTITCQASQSQRYNVAWYQQKPGKAPKLLIYYASNRYTGVPSRFSGSGSGTDFTFTISSLQPEDIATYFCQHHYSSPLTFGGGTKLEIK

SEQ ID NO: 707 - protein, 107 aa, synthetic construct
  REGION 1..107: note = >Hu-VL3_R29H90S93
SIQMTQSPSSLSASVGDRVTITCQASQSRRYNVAWYQQKPGKAPKLLIYYASNRYTGVPSRFSGSGSGTDFTFTISSLQPEDIATYFCQHHYSSPLTFGGGTKLEIK

SEQ ID NO: 708 - protein, 107 aa, synthetic construct
  REGION 1..107: note = >Hu-VL3_S29H90S93
SIQMTQSPSSLSASVGDRVTITCQASQSSRYNVAWYQQKPGKAPKLLIYYASNRYTGVPSRFSGSGSGTDFTFTISSLQPEDIATYFCQHHYSSPLTFGGGTKLEIK

SEQ ID NO: 709 - protein, 107 aa, synthetic construct
  REGION 1..107: note = >Hu-VL3_T29H90S93
SIQMTQSPSSLSASVGDRVTITCQASQSTRYNVAWYQQKPGKAPKLLIYYASNRYTGVPSRFSGSGSGTDFTFTISSLQPEDIATYFCQHHYSSPLTFGGGTKLEIK

SEQ ID NO: 710 - protein, 107 aa, synthetic construct
  REGION 1..107: note = >Hu-VL3_A30H90S93
SIQMTQSPSSLSASVGDRVTITCQASQSVAYNVAWYQQKPGKAPKLLIYYASNRYTGVPSRFSGSGSGTDFTFTISSLQPEDIATYFCQHHYSSPLTFGGGTKLEIK

SEQ ID NO: 711 - protein, 107 aa, synthetic construct
  REGION 1..107: note = >Hu-VL3_D30H90S93
SIQMTQSPSSLSASVGDRVTITCQASQSVDYNVAWYQQKPGKAPKLLIYYASNRYTGVPSRFSGSGSGTDFTFTISSLQPEDIATYFCQHHYSSPLTFGGGTKLEIK

SEQ ID NO: 712 - protein, 107 aa, synthetic construct
  REGION 1..107: note = >Hu-VL3_G30H90S93
SIQMTQSPSSLSASVGDRVTITCQASQSVGYNVAWYQQKPGKAPKLLIYYASNRYTGVPSRFSGSGSGTDFTFTISSLQPEDIATYFCQHHYSSPLTFGGGTKLEIK

SEQ ID NO: 713 - protein, 107 aa, synthetic construct
  REGION 1..107: note = >Hu-VL3_I30H90S93
SIQMTQSPSSLSASVGDRVTITCQASQSVIYNVAWYQQKPGKAPKLLIYYASNRYTGVPSRFSGSGSGTDFTFTISSLQPEDIATYFCQHHYSSPLTFGGGTKLEIK

SEQ ID NO: 714 - protein, 107 aa, synthetic construct
  REGION 1..107: note = >Hu-VL3_K30H90S93
SIQMTQSPSSLSASVGDRVTITCQASQSVKYNVAWYQQKPGKAPKLLIYYASNRYTGVPSRFSGSGSGTDFTFTISSLQPEDIATYFCQHHYSSPLTFGGGTKLEIK

SEQ ID NO: 715 - protein, 107 aa, synthetic construct
  REGION 1..107: note = >Hu-VL3_N30H90S93
SIQMTQSPSSLSASVGDRVTITCQASQSVNYNVAWYQQKPGKAPKLLIYYASNRYTGVPSRFSGSGSGTDFTFTISSLQPEDIATYFCQHHYSSPLTFGGGTKLEIK

SEQ ID NO: 716 - protein, 107 aa, synthetic construct
  REGION 1..107: note = >HuVL3_H90S93_Y31N
SIQMTQSPSSLSASVGDRVTITCQASQSVRNNVAWYQQKPGKAPKLLIYYASNRYTGVPSRFSGSGSGTDFTFTISSLQPEDIATYFCQHHYSSPLTFGGGTKLEIK

SEQ ID NO: 717 - protein, 107 aa, synthetic construct
  REGION 1..107: note = >Hu-VL3_A32H90S93
SIQMTQSPSSLSASVGDRVTITCQASQSVRYAVAWYQQKPGKAPKLLIYYASNRYTGVPSRFSGSGSGTDFTFTISSLQPEDIATYFCQHHYSSPLTFGGGTKLEIK

SEQ ID NO: 718 - protein, 107 aa, synthetic construct
  REGION 1..107: note = >Hu-VL3_D32H90S93
SIQMTQSPSSLSASVGDRVTITCQASQSVRYDVAWYQQKPGKAPKLLIYYASNRYTGVPSRFSGSGSGTDFTFTISSLQPEDIATYFCQHHYSSPLTFGGGTKLEIK

SEQ ID NO: 719 - protein, 107 aa, synthetic construct
  REGION 1..107: note = >Hu-VL3_F32H90S93
SIQMTQSPSSLSASVGDRVTITCQASQSVRYFVAWYQQKPGKAPKLLIYYASNRYTGVPSRFSGSGSGTDFTFTISSLQPEDIATYFCQHHYSSPLTFGGGTKLEIK

SEQ ID NO: 720 - protein, 107 aa, synthetic construct
  REGION 1..107: note = >Hu-VL3_G32H90S93
SIQMTQSPSSLSASVGDRVTITCQASQSVRYGVAWYQQKPGKAPKLLIYYASNRYTGVPSRFSGSGSGTDFTFTISSLQPEDIATYFCQHHYSSPLTFGGGTKLEIK

SEQ ID NO: 721 - protein, 107 aa, synthetic construct
  REGION 1..107: note = >Hu-VL3_H32H90S93
SIQMTQSPSSLSASVGDRVTITCQASQSVRYHVAWYQQKPGKAPKLLIYYASNRYTGVPSRFSGSGSGTDFTFTISSLQPEDIATYFCQHHYSSPLTFGGGTKLEIK

SEQ ID NO: 722 - protein, 107 aa, synthetic construct
  REGION 1..107: note = >Hu-VL3_L32H90S93
SIQMTQSPSSLSASVGDRVTITCQASQSVRYLVAWYQQKPGKAPKLLIYYASNRYTGVPSRFSGSGSGTDFTFTISSLQPEDIATYFCQHHYSSPLTFGGGTKLEIK

SEQ ID NO: 723 - protein, 107 aa, synthetic construct
  REGION 1..107: note = >Hu-VL3_A33H90S93
SIQMTQSPSSLSASVGDRVTITCQASQSVRYNAAWYQQKPGKAPKLLIYYASNRYTGVPSRFSGSGSGTDFTFTISSLQPEDIATYFCQHHYSSPLTFGGGTKLEIK

SEQ ID NO: 724 - protein, 107 aa, synthetic construct
  REGION 1..107: note = >Hu-VL3_I33H90S93
SIQMTQSPSSLSASVGDRVTITCQASQSVRYNIAWYQQKPGKAPKLLIYYASNRYTGVPSRFSGSGSGTDFTFTISSLQPEDIATYFCQHHYSSPLTFGGGTKLEIK

SEQ ID NO: 725 - protein, 107 aa, synthetic construct
  REGION 1..107: note = >Hu-VL3_K33H90S93
SIQMTQSPSSLSASVGDRVTITCQASQSVRYNKAWYQQKPGKAPKLLIYYASNRYTGVPSRFSGSGSGTDFTFTISSLQPEDIATYFCQHHYSSPLTFGGGTKLEIK

SEQ ID NO: 726 - protein, 107 aa, synthetic construct
  REGION 1..107: note = >HuVL3_H90S93_V33L
SIQMTQSPSSLSASVGDRVTITCQASQSVRYNLAWYQQKPGKAPKLLIYYASNRYTGVPSRFSGSGSGTDFTFTISSLQPEDIATYFCQHHYSSPLTFGGGTKLEIK

SEQ ID NO: 727 - protein, 107 aa, synthetic construct
  REGION 1..107: note = >Tgex 207B7huVL3_M33D56H90S93
SIQMTQSPSSLSASVGDRVTITCQASQSVRYNMAWYQQKPGKAPKLLIYYASNRYDGVPSRFSGSGSGTDFTFTISSLQPEDIATYFCQHHYSSPLTFGGGTKLEIK

SEQ ID NO: 728 - protein, 107 aa, synthetic construct
  REGION 1..107: note = >Tgex 207B7huVL3_M33D56Y87H90S93
SIQMTQSPSSLSASVGDRVTITCQASQSVRYNMAWYQQKPGKAPKLLIYYASNRYDGVPSRFSGSGSGTDFTFTISSLQPEDIATYYCQHHYSSPLTFGGGTKLEIK

SEQ ID NO: 729 - protein, 107 aa, synthetic construct
  REGION 1..107: note = >Tgex 207B7huVL3_M33E56H90S93
SIQMTQSPSSLSASVGDRVTITCQASQSVRYNMAWYQQKPGKAPKLLIYYASNRYEGVPSRFSGSGSGTDFTFTISSLQPEDIATYFCQHHYSSPLTFGGGTKLEIK

SEQ ID NO: 730 - protein, 107 aa, synthetic construct
  REGION 1..107: note = >Tgex 207B7huVL3_M33E56Y87H90S93
SIQMTQSPSSLSASVGDRVTITCQASQSVRYNMAWYQQKPGKAPKLLIYYASNRYEGVPSRFSGSGSGTDFTFTISSLQPEDIATYYCQHHYSSPLTFGGGTKLEIK

SEQ ID NO: 731 - protein, 107 aa, synthetic construct
  REGION 1..107: note = >Hu-VL3_M33H90S93
SIQMTQSPSSLSASVGDRVTITCQASQSVRYNMAWYQQKPGKAPKLLIYYASNRYTGVPSRFSGSGSGTDFTFTISSLQPEDIATYFCQHHYSSPLTFGGGTKLEIK

SEQ ID NO: 732 - protein, 107 aa, synthetic construct
  REGION 1..107: note = >Tgex 207B7huVL3_M33Y87H90S93
SIQMTQSPSSLSASVGDRVTITCQASQSVRYNMAWYQQKPGKAPKLLIYYASNRYTGVPSRFSGSGSGTDFTFTISSLQPEDIATYYCQHHYSSPLTFGGGTKLEIK

SEQ ID NO: 733 - protein, 107 aa, synthetic construct
  REGION 1..107: note = >Tgex 207B7huVL3_M33G34D56H90S93
SIQMTQSPSSLSASVGDRVTITCQASQSVRYNMGWYQQKPGKAPKLLIYYASNRYDGVPSRFSGSGSGTDFTFTISSLQPEDIATYFCQHHYSSPLTFGGGTKLEIK

SEQ ID NO: 734 - protein, 107 aa, synthetic construct
  REGION 1..107: note = >Tgex 207B7huVL3_M33G34D56Y87H90S93
SIQMTQSPSSLSASVGDRVTITCQASQSVRYNMGWYQQKPGKAPKLLIYYASNRYDGVPSRFSGSGSGTDFTFTISSLQPEDIATYYCQHHYSSPLTFGGGTKLEIK

SEQ ID NO: 735 - protein, 107 aa, synthetic construct
  REGION 1..107: note = >Tgex 207B7huVL3_M33G34E56H90S93
SIQMTQSPSSLSASVGDRVTITCQASQSVRYNMGWYQQKPGKAPKLLIYYASNRYEGVPSRFSGSGSGTDFTFTISSLQPEDIATYFCQHHYSSPLTFGGGTKLEIK

SEQ ID NO: 736 - protein, 107 aa, synthetic construct
  REGION 1..107: note = >Tgex 207B7huVL3_M33G34E56Y87H90S93
SIQMTQSPSSLSASVGDRVTITCQASQSVRYNMGWYQQKPGKAPKLLIYYASNRYEGVPSRFSGSGSGTDFTFTISSLQPEDIATYYCQHHYSSPLTFGGGTKLEIK

SEQ ID NO: 737 - protein, 107 aa, synthetic construct
  REGION 1..107: note = >Tgex 207B7huVL3_M33G34H90S93
SIQMTQSPSSLSASVGDRVTITCQASQSVRYNMGWYQQKPGKAPKLLIYYASNRYTGVPSRFSGSGSGTDFTFTISSLQPEDIATYFCQHHYSSPLTFGGGTKLEIK

SEQ ID NO: 738 - protein, 107 aa, synthetic construct
  REGION 1..107: note = >Tgex 207B7huVL3_M33G34Y87H90S93
SIQMTQSPSSLSASVGDRVTITCQASQSVRYNMGWYQQKPGKAPKLLIYYASNRYTGVPSRFSGSGSGTDFTFTISSLQPEDIATYYCQHHYSSPLTFGGGTKLEIK

SEQ ID NO: 739 - protein, 107 aa, synthetic construct
  REGION 1..107: note = >Hu-VL3_P33H90S93
SIQMTQSPSSLSASVGDRVTITCQASQSVRYNPAWYQQKPGKAPKLLIYYASNRYTGVPSRFSGSGSGTDFTFTISSLQPEDIATYFCQHHYSSPLTFGGGTKLEIK

SEQ ID NO: 740 - protein, 107 aa, synthetic construct
  REGION 1..107: note = >HuVL3_H90S93_Y50A
SIQMTQSPSSLSASVGDRVTITCQASQSVRYNVAWYQQKPGKAPKLLIYAASNRYTGVPSRFSGSGSGTDFTFTISSLQPEDIATYFCQHHYSSPLTFGGGTKLEIK

SEQ ID NO: 741 - protein, 107 aa, synthetic construct
  REGION 1..107: note = >HuVL3_H90S93_YRY-DLE
SIQMTQSPSSLSASVGDRVTITCQASQSVRYNVAWYQQKPGKAPKLLIYDASNLETGVPSRFSGSGSGTDFTFTISSLQPEDIATYFCQHHYSSPLTFGGGTKLEIK

SEQ ID NO: 742 - protein, 107 aa, synthetic construct
  REGION 1..107: note = >HuVL3_H90S93_Y50D
SIQMTQSPSSLSASVGDRVTITCQASQSVRYNVAWYQQKPGKAPKLLIYDASNRYTGVPSRFSGSGSGTDFTFTISSLQPEDIATYFCQHHYSSPLTFGGGTKLEIK

SEQ ID NO: 743 - protein, 107 aa, synthetic construct
  REGION 1..107: note = >HuVL3_H90S93_S52A
SIQMTQSPSSLSASVGDRVTITCQASQSVRYNVAWYQQKPGKAPKLLIYYAANRYTGVPSRFSGSGSGTDFTFTISSLQPEDIATYFCQHHYSSPLTFGGGTKLEIK

SEQ ID NO: 744 - protein, 107 aa, synthetic construct
  REGION 1..107: note = >HuVL3_H90S93_N53A
SIQMTQSPSSLSASVGDRVTITCQASQSVRYNVAWYQQKPGKAPKLLIYYASARYTGVPSRFSGSGSGTDFTFTISSLQPEDIATYFCQHHYSSPLTFGGGTKLEIK

SEQ ID NO: 745 - protein, 107 aa, synthetic construct
  REGION 1..107: note = >Hu-VL3_D53H90S93
SIQMTQSPSSLSASVGDRVTITCQASQSVRYNVAWYQQKPGKAPKLLIYYASDRYTGVPSRFSGSGSGTDFTFTISSLQPEDIATYFCQHHYSSPLTFGGGTKLEIK

SEQ ID NO: 746 - protein, 107 aa, synthetic construct
  REGION 1..107: note = >Hu-VL3_E53H90S93
SIQMTQSPSSLSASVGDRVTITCQASQSVRYNVAWYQQKPGKAPKLLIYYASERYTGVPSRFSGSGSGTDFTFTISSLQPEDIATYFCQHHYSSPLTFGGGTKLEIK

SEQ ID NO: 747 - protein, 107 aa, synthetic construct
  REGION 1..107: note = >huVL3_K53D56H90D93
SIQMTQSPSSLSASVGDRVTITCQASQSVRYNVAWYQQKPGKAPKLLIYYASKRYDGVPSRFSGSGSGTDFTFTISSLQPEDIATYFCQHHYDSPLTFGGGTKLEIK

SEQ ID NO: 748 - protein, 107 aa, synthetic construct
  REGION 1..107: note = >huVL3_K53D56H90S93
SIQMTQSPSSLSASVGDRVTITCQASQSVRYNVAWYQQKPGKAPKLLIYYASKRYDGVPSRFSGSGSGTDFTFTISSLQPEDIATYFCQHHYSSPLTFGGGTKLEIK

SEQ ID NO: 749 - protein, 107 aa, synthetic construct
  REGION 1..107: note = >huVL3_K53K56H90D93
SIQMTQSPSSLSASVGDRVTITCQASQSVRYNVAWYQQKPGKAPKLLIYYASKRYKGVPSRFSGSGSGTDFTFTISSLQPEDIATYFCQHHYDSPLTFGGGTKLEIK

SEQ ID NO: 750 - protein, 107 aa, synthetic construct
  REGION 1..107: note = >huVL3_K53K56H90S93
SIQMTQSPSSLSASVGDRVTITCQASQSVRYNVAWYQQKPGKAPKLLIYYASKRYKGVPSRFSGSGSGTDFTFTISSLQPEDIATYFCQHHYSSPLTFGGGTKLEIK

SEQ ID NO: 751 - protein, 107 aa, synthetic construct
  REGION 1..107: note = >huVL3_K53H90D93
SIQMTQSPSSLSASVGDRVTITCQASQSVRYNVAWYQQKPGKAPKLLIYYASKRYTGVPSRFSGSGSGTDFTFTISSLQPEDIATYFCQHHYDSPLTFGGGTKLEIK

SEQ ID NO: 752 - protein, 107 aa, synthetic construct
  REGION 1..107: note = >Hu-VL3_K53H90S93
SIQMTQSPSSLSASVGDRVTITCQASQSVRYNVAWYQQKPGKAPKLLIYYASKRYTGVPSRFSGSGSGTDFTFTISSLQPEDIATYFCQHHYSSPLTFGGGTKLEIK

SEQ ID NO: 753 - protein, 107 aa, synthetic construct
  REGION 1..107: note = >HuVL3_H90S93_R54A
SIQMTQSPSSLSASVGDRVTITCQASQSVRYNVAWYQQKPGKAPKLLIYYASNAYTGVPSRFSGSGSGTDFTFTISSLQPEDIATYFCQHHYSSPLTFGGGTKLEIK

SEQ ID NO: 754 - protein, 107 aa, synthetic construct
  REGION 1..107: note = >Hu-VL3_G54H90S93
SIQMTQSPSSLSASVGDRVTITCQASQSVRYNVAWYQQKPGKAPKLLIYYASNGYTGVPSRFSGSGSGTDFTFTISSLQPEDIATYFCQHHYSSPLTFGGGTKLEIK

SEQ ID NO: 755 - protein, 107 aa, synthetic construct
  REGION 1..107: note = >Hu-VL3_K54H90S93
SIQMTQSPSSLSASVGDRVTITCQASQSVRYNVAWYQQKPGKAPKLLIYYASNKYTGVPSRFSGSGSGTDFTFTISSLQPEDIATYFCQHHYSSPLTFGGGTKLEIK

SEQ ID NO: 756 - protein, 107 aa, synthetic construct
  REGION 1..107: note = >HuVL3_H90S93_RY-LE
SIQMTQSPSSLSASVGDRVTITCQASQSVRYNVAWYQQKPGKAPKLLIYYASNLETGVPSRFSGSGSGTDFTFTISSLQPEDIATYFCQHHYSSPLTFGGGTKLEIK

SEQ ID NO: 757 - protein, 107 aa, synthetic construct
  REGION 1..107: note = >HuVL3_H90S93_R54L
SIQMTQSPSSLSASVGDRVTITCQASQSVRYNVAWYQQKPGKAPKLLIYYASNLYTGVPSRFSGSGSGTDFTFTISSLQPEDIATYFCQHHYSSPLTFGGGTKLEIK

SEQ ID NO: 758 - protein, 107 aa, synthetic construct
  REGION 1..107: note = >HuVL4_H90S93_D1S
SIQMTQSPSSLSASVGDRVTITCQASQSVRYNVAWYQQKPGKAPKLLIYYASNLYTGVPSRFSGSGSGTDFTFTISSLQPEDIATYYCQHHYSSPLTFGGGTKLEIK

SEQ ID NO: 759 - protein, 107 aa, synthetic construct
  REGION 1..107: note = >HuVL3_H90S93_Y55A
SIQMTQSPSSLSASVGDRVTITCQASQSVRYNVAWYQQKPGKAPKLLIYYASNRATGVPSRFSGSGSGTDFTFTISSLQPEDIATYFCQHHYSSPLTFGGGTKLEIK

SEQ ID NO: 760 - protein, 107 aa, synthetic construct
  REGION 1..107: note = >HuVL3_H90S93_Y55E
SIQMTQSPSSLSASVGDRVTITCQASQSVRYNVAWYQQKPGKAPKLLIYYASNRETGVPSRFSGSGSGTDFTFTISSLQPEDIATYFCQHHYSSPLTFGGGTKLEIK

SEQ ID NO: 761 - protein, 107 aa, synthetic construct
  REGION 1..107: note = >HuVL3_H90S93_T56A
SIQMTQSPSSLSASVGDRVTITCQASQSVRYNVAWYQQKPGKAPKLLIYYASNRYAGVPSRFSGSGSGTDFTFTISSLQPEDIATYFCQHHYSSPLTFGGGTKLEIK

SEQ ID NO: 762 - protein, 107 aa, synthetic construct
  REGION 1..107: note = >huVL3_D56H90D93
SIQMTQSPSSLSASVGDRVTITCQASQSVRYNVAWYQQKPGKAPKLLIYYASNRYDGVPSRFSGSGSGTDFTFTISSLQPEDIATYFCQHHYDSPLTFGGGTKLEIK

SEQ ID NO: 763 - protein, 107 aa, synthetic construct
  REGION 1..107: note = >Tgex 207B7huVL3_D56Y87H90S93
SIQMTQSPSSLSASVGDRVTITCQASQSVRYNVAWYQQKPGKAPKLLIYYASNRYDGVPSRFSGSGSGTDFTFTISSLQPEDIATYYCQHHYSSPLTFGGGTKLEIK

SEQ ID NO: 764 - protein, 107 aa, synthetic construct
  REGION 1..107: note = >Tgex 207B7huVL3_E56Y87H90S93
SIQMTQSPSSLSASVGDRVTITCQASQSVRYNVAWYQQKPGKAPKLLIYYASNRYEGVPSRFSGSGSGTDFTFTISSLQPEDIATYYCQHHYSSPLTFGGGTKLEIK

SEQ ID NO: 765 - protein, 107 aa, synthetic construct
  REGION 1..107: note = >huVL3_K56H90D93
SIQMTQSPSSLSASVGDRVTITCQASQSVRYNVAWYQQKPGKAPKLLIYYASNRYKGVPSRFSGSGSGTDFTFTISSLQPEDIATYFCQHHYDSPLTFGGGTKLEIK

SEQ ID NO: 766 - protein, 107 aa, synthetic construct
  REGION 1..107: note = >Hu-VL3_L89H90S93
SIQMTQSPSSLSASVGDRVTITCQASQSVRYNVAWYQQKPGKAPKLLIYYASNRYTGVPSRFSGSGSGTDFTFTISSLQPEDIATYFCLHHYSSPLTFGGGTKLEIK

SEQ ID NO: 767 - protein, 107 aa, synthetic construct
  REGION 1..107: note = >Hu-VL3_L89
SIQMTQSPSSLSASVGDRVTITCQASQSVRYNVAWYQQKPGKAPKLLIYYASNRYTGVPSRFSGSGSGTDFTFTISSLQPEDIATYFCLQHYNSPLTFGGGTKLEIK

SEQ ID NO: 768 - protein, 107 aa, synthetic construct
  REGION 1..107: note = >Hu-VL3_A90S93
SIQMTQSPSSLSASVGDRVTITCQASQSVRYNVAWYQQKPGKAPKLLIYYASNRYTGVPSRFSGSGSGTDFTFTISSLQPEDIATYFCQAHYSSPLTFGGGTKLEIK

SEQ ID NO: 769 - protein, 107 aa, synthetic construct
  REGION 1..107: note = >Hu-VL3_G90S93
SIQMTQSPSSLSASVGDRVTITCQASQSVRYNVAWYQQKPGKAPKLLIYYASNRYTGVPSRFSGSGSGTDFTFTISSLQPEDIATYFCQGHYSSPLTFGGGTKLEIK

SEQ ID NO: 770 - protein, 107 aa, synthetic construct
  REGION 1..107: note = >Hu-VL3_H90A91S93
SIQMTQSPSSLSASVGDRVTITCQASQSVRYNVAWYQQKPGKAPKLLIYYASNRYTGVPSRFSGSGSGTDFTFTISSLQPEDIATYFCQHAYSSPLTFGGGTKLEIK

SEQ ID NO: 771 - protein, 107 aa, synthetic construct
  REGION 1..107: note = >Hu-VL3_H90D91S93
SIQMTQSPSSLSASVGDRVTITCQASQSVRYNVAWYQQKPGKAPKLLIYYASNRYTGVPSRFSGSGSGTDFTFTISSLQPEDIATYFCQHDYSSPLTFGGGTKLEIK

SEQ ID NO: 772 - protein, 107 aa, synthetic construct
  REGION 1..107: note = >Hu-VL3_H90F91S93
SIQMTQSPSSLSASVGDRVTITCQASQSVRYNVAWYQQKPGKAPKLLIYYASNRYTGVPSRFSGSGSGTDFTFTISSLQPEDIATYFCQHFYSSPLTFGGGTKLEIK

SEQ ID NO: 773 - protein, 107 aa, synthetic construct
  REGION 1..107: note = >Hu-VL3_H90G91S93
SIQMTQSPSSLSASVGDRVTITCQASQSVRYNVAWYQQKPGKAPKLLIYYASNRYTGVPSRFSGSGSGTDFTFTISSLQPEDIATYFCQHGYSSPLTFGGGTKLEIK

SEQ ID NO: 774 - protein, 107 aa, synthetic construct
  REGION 1..107: note = >HuVL3_H90S93_Y92D
SIQMTQSPSSLSASVGDRVTITCQASQSVRYNVAWYQQKPGKAPKLLIYYASNRYTGVPSRFSGSGSGTDFTFTISSLQPEDIATYFCQHHDSSPLTFGGGTKLEIK

SEQ ID NO: 775 - protein, 107 aa, synthetic construct
  REGION 1..107: note = >Hu-VL3_H90L92A93
SIQMTQSPSSLSASVGDRVTITCQASQSVRYNVAWYQQKPGKAPKLLIYYASNRYTGVPSRFSGSGSGTDFTFTISSLQPEDIATYFCQHHLASPLTFGGGTKLEIK

SEQ ID NO: 776 - protein, 107 aa, synthetic construct
  REGION 1..107: note = >Hu-VL3_H90L92S93
SIQMTQSPSSLSASVGDRVTITCQASQSVRYNVAWYQQKPGKAPKLLIYYASNRYTGVPSRFSGSGSGTDFTFTISSLQPEDIATYFCQHHLSSPLTFGGGTKLEIK

SEQ ID NO: 777 - protein, 107 aa, synthetic construct
  REGION 1..107: note = >HuVL3_Q90H_A93
SIQMTQSPSSLSASVGDRVTITCQASQSVRYNVAWYQQKPGKAPKLLIYYASNRYTGVPSRFSGSGSGTDFTFTISSLQPEDIATYFCQHHYASPLTFGGGTKLEIK

SEQ ID NO: 778 - protein, 107 aa, synthetic construct
  REGION 1..107: note = >HuVL3_Q90H_D93
SIQMTQSPSSLSASVGDRVTITCQASQSVRYNVAWYQQKPGKAPKLLIYYASNRYTGVPSRFSGSGSGTDFTFTISSLQPEDIATYFCQHHYDSPLTFGGGTKLEIK

SEQ ID NO: 779 - protein, 107 aa, synthetic construct
  REGION 1..107: note = >HuVL3_Q90H_E93
SIQMTQSPSSLSASVGDRVTITCQASQSVRYNVAWYQQKPGKAPKLLIYYASNRYTGVPSRFSGSGSGTDFTFTISSLQPEDIATYFCQHHYESPLTFGGGTKLEIK

SEQ ID NO: 780 - protein, 107 aa, synthetic construct
  REGION 1..107: note = >HuVL3_Q90H_F93
SIQMTQSPSSLSASVGDRVTITCQASQSVRYNVAWYQQKPGKAPKLLIYYASNRYTGVPSRFSGSGSGTDFTFTISSLQPEDIATYFCQHHYFSPLTFGGGTKLEIK

SEQ ID NO: 781 - protein, 107 aa, synthetic construct
  REGION 1..107: note = >HuVL3_Q90H_G93
SIQMTQSPSSLSASVGDRVTITCQASQSVRYNVAWYQQKPGKAPKLLIYYASNRYTGVPSRFSGSGSGTDFTFTISSLQPEDIATYFCQHHYGSPLTFGGGTKLEIK

SEQ ID NO: 782 - protein, 107 aa, synthetic construct
  REGION 1..107: note = >HuVL3_Q90H_H93
SIQMTQSPSSLSASVGDRVTITCQASQSVRYNVAWYQQKPGKAPKLLIYYASNRYTGVPSRFSGSGSGTDFTFTISSLQPEDIATYFCQHHYHSPLTFGGGTKLEIK

SEQ ID NO: 783 - protein, 107 aa, synthetic construct
  REGION 1..107: note = >HuVL3_Q90H_I93
SIQMTQSPSSLSASVGDRVTITCQASQSVRYNVAWYQQKPGKAPKLLIYYASNRYTGVPSRFSGSGSGTDFTFTISSLQPEDIATYFCQHHYISPLTFGGGTKLEIK

SEQ ID NO: 784 - protein, 107 aa, synthetic construct
  REGION 1..107: note = >HuVL3_Q90H_K93
SIQMTQSPSSLSASVGDRVTITCQASQSVRYNVAWYQQKPGKAPKLLIYYASNRYTGVPSRFSGSGSGTDFTFTISSLQPEDIATYFCQHHYKSPLTFGGGTKLEIK

SEQ ID NO: 785 - protein, 107 aa, synthetic construct
  REGION 1..107: note = >HuVL3_Q90H_L93
SIQMTQSPSSLSASVGDRVTITCQASQSVRYNVAWYQQKPGKAPKLLIYYASNRYTGVPSRFSGSGSGTDFTFTISSLQPEDIATYFCQHHYLSPLTFGGGTKLEIK

SEQ ID NO: 786 - protein, 107 aa, synthetic construct
  REGION 1..107: note = >HuVL3_Q90H_M93
SIQMTQSPSSLSASVGDRVTITCQASQSVRYNVAWYQQKPGKAPKLLIYYASNRYTGVPSRFSGSGSGTDFTFTISSLQPEDIATYFCQHHYMSPLTFGGGTKLEIK

SEQ ID NO: 787 - protein, 107 aa, synthetic construct
  REGION 1..107: note = >Hu-VL3_H90Y97
SIQMTQSPSSLSASVGDRVTITCQASQSVRYNVAWYQQKPGKAPKLLIYYASNRYTGVPSRFSGSGSGTDFTFTISSLQPEDIATYFCQHHYNSPLYFGGGTKLEIK

SEQ ID NO: 788 - protein, 107 aa, synthetic construct
  REGION 1..107: note = >HuVL3_Q90H_P93
SIQMTQSPSSLSASVGDRVTITCQASQSVRYNVAWYQQKPGKAPKLLIYYASNRYTGVPSRFSGSGSGTDFTFTISSLQPEDIATYFCQHHYPSPLTFGGGTKLEIK

SEQ ID NO: 789 - protein, 107 aa, synthetic construct
  REGION 1..107: note = >HuVL3_Q90H_Q93
SIQMTQSPSSLSASVGDRVTITCQASQSVRYNVAWYQQKPGKAPKLLIYYASNRYTGVPSRFSGSGSGTDFTFTISSLQPEDIATYFCQHHYQSPLTFGGGTKLEIK

SEQ ID NO: 790 - protein, 107 aa, synthetic construct
  REGION 1..107: note = >HuVL3_Q90H_R93
SIQMTQSPSSLSASVGDRVTITCQASQSVRYNVAWYQQKPGKAPKLLIYYASNRYTGVPSRFSGSGSGTDFTFTISSLQPEDIATYFCQHHYRSPLTFGGGTKLEIK

SEQ ID NO: 791 - protein, 107 aa, synthetic construct
  REGION 1..107: note = >Hu-VL3_H90S93A94
SIQMTQSPSSLSASVGDRVTITCQASQSVRYNVAWYQQKPGKAPKLLIYYASNRYTGVPSRFSGSGSGTDFTFTISSLQPEDIATYFCQHHYSAPLTFGGGTKLEIK

SEQ ID NO: 792 - protein, 107 aa, synthetic construct
  REGION 1..107: note = >Hu-VL3_H90S93D94
SIQMTQSPSSLSASVGDRVTITCQASQSVRYNVAWYQQKPGKAPKLLIYYASNRYTGVPSRFSGSGSGTDFTFTISSLQPEDIATYFCQHHYSDPLTFGGGTKLEIK

SEQ ID NO: 793 - protein, 107 aa, synthetic construct
  REGION 1..107: note = >Hu-VL3_H90S93F94
SIQMTQSPSSLSASVGDRVTITCQASQSVRYNVAWYQQKPGKAPKLLIYYASNRYTGVPSRFSGSGSGTDFTFTISSLQPEDIATYFCQHHYSFPLTFGGGTKLEIK

SEQ ID NO: 794 - protein, 107 aa, synthetic construct
  REGION 1..107: note = >Hu-VL3_H90S93G94
SIQMTQSPSSLSASVGDRVTITCQASQSVRYNVAWYQQKPGKAPKLLIYYASNRYTGVPSRFSGSGSGTDFTFTISSLQPEDIATYFCQHHYSGPLTFGGGTKLEIK

SEQ ID NO: 795 - protein, 107 aa, synthetic construct
  REGION 1..107: note = >Hu-VL3_H90S93I94
SIQMTQSPSSLSASVGDRVTITCQASQSVRYNVAWYQQKPGKAPKLLIYYASNRYTGVPSRFSGSGSGTDFTFTISSLQPEDIATYFCQHHYSIPLTFGGGTKLEIK

SEQ ID NO: 796 - protein, 107 aa, synthetic construct
  REGION 1..107: note = >HuVL3_H90S93_S94L
SIQMTQSPSSLSASVGDRVTITCQASQSVRYNVAWYQQKPGKAPKLLIYYASNRYTGVPSRFSGSGSGTDFTFTISSLQPEDIATYFCQHHYSLPLTFGGGTKLEIK

SEQ ID NO: 797 - protein, 107 aa, synthetic construct
  REGION 1..107: note = >Hu-VL3_H90S93N94
SIQMTQSPSSLSASVGDRVTITCQASQSVRYNVAWYQQKPGKAPKLLIYYASNRYTGVPSRFSGSGSGTDFTFTISSLQPEDIATYFCQHHYSNPLTFGGGTKLEIK

SEQ ID NO: 798 - protein, 107 aa, synthetic construct
  REGION 1..107: note = >Hu-VL3_H90S93R94
SIQMTQSPSSLSASVGDRVTITCQASQSVRYNVAWYQQKPGKAPKLLIYYASNRYTGVPSRFSGSGSGTDFTFTISSLQPEDIATYFCQHHYSRPLTFGGGTKLEIK

SEQ ID NO: 799 - protein, 107 aa, synthetic construct
  REGION 1..107: note = >Hu-VL3_H90S93E96
SIQMTQSPSSLSASVGDRVTITCQASQSVRYNVAWYQQKPGKAPKLLIYYASNRYTGVPSRFSGSGSGTDFTFTISSLQPEDIATYFCQHHYSSPETFGGGTKLEIK

SEQ ID NO: 800 - protein, 107 aa, synthetic construct
  REGION 1..107: note = >Hu-VL3_H90S93Y97
SIQMTQSPSSLSASVGDRVTITCQASQSVRYNVAWYQQKPGKAPKLLIYYASNRYTGVPSRFSGSGSGTDFTFTISSLQPEDIATYFCQHHYSSPLYFGGGTKLEIK

SEQ ID NO: 801 - protein, 107 aa, synthetic construct
  REGION 1..107: note = >Hu-VL3_H90S93T94
SIQMTQSPSSLSASVGDRVTITCQASQSVRYNVAWYQQKPGKAPKLLIYYASNRYTGVPSRFSGSGSGTDFTFTISSLQPEDIATYFCQHHYSTPLTFGGGTKLEIK

SEQ ID NO: 802 - protein, 107 aa, synthetic construct
  REGION 1..107: note = >Hu-VL3_H90S93V94
SIQMTQSPSSLSASVGDRVTITCQASQSVRYNVAWYQQKPGKAPKLLIYYASNRYTGVPSRFSGSGSGTDFTFTISSLQPEDIATYFCQHHYSVPLTFGGGTKLEIK

SEQ ID NO: 803 - protein, 107 aa, synthetic construct
  REGION 1..107: note = >Hu-VL3_H90S93W94
SIQMTQSPSSLSASVGDRVTITCQASQSVRYNVAWYQQKPGKAPKLLIYYASNRYTGVPSRFSGSGSGTDFTFTISSLQPEDIATYFCQHHYSWPLTFGGGTKLEIK

SEQ ID NO: 804 - protein, 107 aa, synthetic construct
  REGION 1..107: note = >Hu-VL3_H90S93Y94
SIQMTQSPSSLSASVGDRVTITCQASQSVRYNVAWYQQKPGKAPKLLIYYASNRYTGVPSRFSGSGSGTDFTFTISSLQPEDIATYFCQHHYSYPLTFGGGTKLEIK

SEQ ID NO: 805 - protein, 107 aa, synthetic construct
  REGION 1..107: note = >HuVL3_Q90H_T93
SIQMTQSPSSLSASVGDRVTITCQASQSVRYNVAWYQQKPGKAPKLLIYYASNRYTGVPSRFSGSGSGTDFTFTISSLQPEDIATYFCQHHYTSPLTFGGGTKLEIK

SEQ ID NO: 806 - protein, 107 aa, synthetic construct
  REGION 1..107: note = >HuVL3_Q90H_V93
SIQMTQSPSSLSASVGDRVTITCQASQSVRYNVAWYQQKPGKAPKLLIYYASNRYTGVPSRFSGSGSGTDFTFTISSLQPEDIATYFCQHHYVSPLTFGGGTKLEIK

SEQ ID NO: 807 - protein, 107 aa, synthetic construct
  REGION 1..107: note = >HuVL3_Q90H_W93
SIQMTQSPSSLSASVGDRVTITCQASQSVRYNVAWYQQKPGKAPKLLIYYASNRYTGVPSRFSGSGSGTDFTFTISSLQPEDIATYFCQHHYWSPLTFGGGTKLEIK

SEQ ID NO: 808 - protein, 107 aa, synthetic construct
  REGION 1..107: note = >HuVL3_Q90H_Y93
SIQMTQSPSSLSASVGDRVTITCQASQSVRYNVAWYQQKPGKAPKLLIYYASNRYTGVPSRFSGSGSGTDFTFTISSLQPEDIATYFCQHHYYSPLTFGGGTKLEIK

SEQ ID NO: 809 - protein, 107 aa, synthetic construct
  REGION 1..107: note = >Hu-VL3_H90L91S93
SIQMTQSPSSLSASVGDRVTITCQASQSVRYNVAWYQQKPGKAPKLLIYYASNRYTGVPSRFSGSGSGTDFTFTISSLQPEDIATYFCQHLYSSPLTFGGGTKLEIK

SEQ ID NO: 810 - protein, 107 aa, synthetic construct
  REGION 1..107: note = >Hu-VL3_H90R91S93
SIQMTQSPSSLSASVGDRVTITCQASQSVRYNVAWYQQKPGKAPKLLIYYASNRYTGVPSRFSGSGSGTDFTFTISSLQPEDIATYFCQHRYSSPLTFGGGTKLEIK

SEQ ID NO: 811 - protein, 107 aa, synthetic construct
  REGION 1..107: note = >Hu-VL3_H90S91S93
SIQMTQSPSSLSASVGDRVTITCQASQSVRYNVAWYQQKPGKAPKLLIYYASNRYTGVPSRFSGSGSGTDFTFTISSLQPEDIATYFCQHSYSSPLTFGGGTKLEIK

SEQ ID NO: 812 - protein, 107 aa, synthetic construct
  REGION 1..107: note = >Hu-VL3_H90T91S93
SIQMTQSPSSLSASVGDRVTITCQASQSVRYNVAWYQQKPGKAPKLLIYYASNRYTGVPSRFSGSGSGTDFTFTISSLQPEDIATYFCQHTYSSPLTFGGGTKLEIK

SEQ ID NO: 813 - protein, 107 aa, synthetic construct
  REGION 1..107: note = >Hu-VL3_H90W91S93
SIQMTQSPSSLSASVGDRVTITCQASQSVRYNVAWYQQKPGKAPKLLIYYASNRYTGVPSRFSGSGSGTDFTFTISSLQPEDIATYFCQHWYSSPLTFGGGTKLEIK

SEQ ID NO: 814 - protein, 107 aa, synthetic construct
  REGION 1..107: note = >HuVL3_H90S93_H91Y
SIQMTQSPSSLSASVGDRVTITCQASQSVRYNVAWYQQKPGKAPKLLIYYASNRYTGVPSRFSGSGSGTDFTFTISSLQPEDIATYFCQHYYSSPLTFGGGTKLEIK

SEQ ID NO: 815 - protein, 107 aa, synthetic construct
  REGION 1..107: note = >Hu-VL3_L90S93
SIQMTQSPSSLSASVGDRVTITCQASQSVRYNVAWYQQKPGKAPKLLIYYASNRYTGVPSRFSGSGSGTDFTFTISSLQPEDIATYFCQLHYSSPLTFGGGTKLEIK

SEQ ID NO: 816 - protein, 107 aa, synthetic construct
  REGION 1..107: note = >Hu-VL3_N90S93
SIQMTQSPSSLSASVGDRVTITCQASQSVRYNVAWYQQKPGKAPKLLIYYASNRYTGVPSRFSGSGSGTDFTFTISSLQPEDIATYFCQNHYSSPLTFGGGTKLEIK

SEQ ID NO: 817 - protein, 107 aa, synthetic construct
  REGION 1..107: note = >Hu-VL3_L92A93
SIQMTQSPSSLSASVGDRVTITCQASQSVRYNVAWYQQKPGKAPKLLIYYASNRYTGVPSRFSGSGSGTDFTFTISSLQPEDIATYFCQQHLASPLTFGGGTKLEIK

SEQ ID NO: 818 - protein, 107 aa, synthetic construct
  REGION 1..107: note = >Hu-VL3_L92
SIQMTQSPSSLSASVGDRVTITCQASQSVRYNVAWYQQKPGKAPKLLIYYASNRYTGVPSRFSGSGSGTDFTFTISSLQPEDIATYFCQQHLNSPLTFGGGTKLEIK

SEQ ID NO: 819 - protein, 107 aa, synthetic construct
  REGION 1..107: note = >Hu-VL3_E96
SIQMTQSPSSLSASVGDRVTITCQASQSVRYNVAWYQQKPGKAPKLLIYYASNRYTGVPSRFSGSGSGTDFTFTISSLQPEDIATYFCQQHYNSPETFGGGTKLEIK

SEQ ID NO: 820 - protein, 107 aa, synthetic construct
  REGION 1..107: note = >Hu-VL3_Y97
SIQMTQSPSSLSASVGDRVTITCQASQSVRYNVAWYQQKPGKAPKLLIYYASNRYTGVPSRFSGSGSGTDFTFTISSLQPEDIATYFCQQHYNSPLYFGGGTKLEIK

SEQ ID NO: 821 - protein, 107 aa, synthetic construct
  REGION 1..107: note = >Hu-VL3_S90S93
SIQMTQSPSSLSASVGDRVTITCQASQSVRYNVAWYQQKPGKAPKLLIYYASNRYTGVPSRFSGSGSGTDFTFTISSLQPEDIATYFCQSHYSSPLTFGGGTKLEIK

SEQ ID NO: 822 - protein, 107 aa, synthetic construct
  REGION 1..107: note = >Hu-VL3_T90S93
SIQMTQSPSSLSASVGDRVTITCQASQSVRYNVAWYQQKPGKAPKLLIYYASNRYTGVPSRFSGSGSGTDFTFTISSLQPEDIATYFCQTHYSSPLTFGGGTKLEIK

SEQ ID NO: 823 - protein, 107 aa, synthetic construct
  REGION 1..107: note = >Hu-VL3_V90S93
SIQMTQSPSSLSASVGDRVTITCQASQSVRYNVAWYQQKPGKAPKLLIYYASNRYTGVPSRFSGSGSGTDFTFTISSLQPEDIATYFCQVHYSSPLTFGGGTKLEIK

SEQ ID NO: 824 - protein, 107 aa, synthetic construct
  REGION 1..107: note = >Hu-VL3_S89H90S93
SIQMTQSPSSLSASVGDRVTITCQASQSVRYNVAWYQQKPGKAPKLLIYYASNRYTGVPSRFSGSGSGTDFTFTISSLQPEDIATYFCSHHYSSPLTFGGGTKLEIK

SEQ ID NO: 825 - protein, 107 aa, synthetic construct
  REGION 1..107: note = >Hu-VL3_S89
SIQMTQSPSSLSASVGDRVTITCQASQSVRYNVAWYQQKPGKAPKLLIYYASNRYTGVPSRFSGSGSGTDFTFTISSLQPEDIATYFCSQHYNSPLTFGGGTKLEIK

SEQ ID NO: 826 - protein, 107 aa, synthetic construct
  REGION 1..107: note = >HuVL3_H90S93_F87Y
SIQMTQSPSSLSASVGDRVTITCQASQSVRYNVAWYQQKPGKAPKLLIYYASNRYTGVPSRFSGSGSGTDFTFTISSLQPEDIATYYCQHHYSSPLTFGGGTKLEIK

SEQ ID NO: 827 - protein, 107 aa, synthetic construct
  REGION 1..107: note = >Hu-VL3_S54H90S93
SIQMTQSPSSLSASVGDRVTITCQASQSVRYNVAWYQQKPGKAPKLLIYYASNSYTGVPSRFSGSGSGTDFTFTISSLQPEDIATYFCQHHYSSPLTFGGGTKLEIK

SEQ ID NO: 828 - protein, 107 aa, synthetic construct
  REGION 1..107: note = >huVL3_Q53D56H90D93
SIQMTQSPSSLSASVGDRVTITCQASQSVRYNVAWYQQKPGKAPKLLIYYASQRYDGVPSRFSGSGSGTDFTFTISSLQPEDIATYFCQHHYDSPLTFGGGTKLEIK

SEQ ID NO: 829 - protein, 107 aa, synthetic construct
  REGION 1..107: note = >huVL3_Q53D56H90S93
SIQMTQSPSSLSASVGDRVTITCQASQSVRYNVAWYQQKPGKAPKLLIYYASQRYDGVPSRFSGSGSGTDFTFTISSLQPEDIATYFCQHHYSSPLTFGGGTKLEIK

SEQ ID NO: 830 - protein, 107 aa, synthetic construct
  REGION 1..107: note = >huVL3_Q53H90D93
SIQMTQSPSSLSASVGDRVTITCQASQSVRYNVAWYQQKPGKAPKLLIYYASQRYTGVPSRFSGSGSGTDFTFTISSLQPEDIATYFCQHHYDSPLTFGGGTKLEIK

SEQ ID NO: 831 - protein, 107 aa, synthetic construct
  REGION 1..107: note = >Hu-VL3_Q53H90S93
SIQMTQSPSSLSASVGDRVTITCQASQSVRYNVAWYQQKPGKAPKLLIYYASQRYTGVPSRFSGSGSGTDFTFTISSLQPEDIATYFCQHHYSSPLTFGGGTKLEIK

SEQ ID NO: 832 - protein, 107 aa, synthetic construct
  REGION 1..107: note = >Hu-VL3_R53H90S93
SIQMTQSPSSLSASVGDRVTITCQASQSVRYNVAWYQQKPGKAPKLLIYYASRRYTGVPSRFSGSGSGTDFTFTISSLQPEDIATYFCQHHYSSPLTFGGGTKLEIK

SEQ ID NO: 833 - protein, 107 aa, synthetic construct
  REGION 1..107: note = >Hu-VL3_S53H90S93
SIQMTQSPSSLSASVGDRVTITCQASQSVRYNVAWYQQKPGKAPKLLIYYASSRYTGVPSRFSGSGSGTDFTFTISSLQPEDIATYFCQHHYSSPLTFGGGTKLEIK

SEQ ID NO: 834 - protein, 107 aa, synthetic construct
  REGION 1..107: note = >Hu-VL3_T53H90S93
SIQMTQSPSSLSASVGDRVTITCQASQSVRYNVAWYQQKPGKAPKLLIYYASTRYTGVPSRFSGSGSGTDFTFTISSLQPEDIATYFCQHHYSSPLTFGGGTKLEIK

SEQ ID NO: 835 - protein, 107 aa, synthetic construct
  REGION 1..107: note = >Hu-VL3_Y53H90S93
SIQMTQSPSSLSASVGDRVTITCQASQSVRYNVAWYQQKPGKAPKLLIYYASYRYTGVPSRFSGSGSGTDFTFTISSLQPEDIATYFCQHHYSSPLTFGGGTKLEIK

SEQ ID NO: 836 - protein, 107 aa, synthetic construct
  REGION 1..107: note = >Hu-VL3_D34H90S93
SIQMTQSPSSLSASVGDRVTITCQASQSVRYNVDWYQQKPGKAPKLLIYYASNRYTGVPSRFSGSGSGTDFTFTISSLQPEDIATYFCQHHYSSPLTFGGGTKLEIK

SEQ ID NO: 837 - protein, 107 aa, synthetic construct
  REGION 1..107: note = >Hu-VL3_E34H90S93
SIQMTQSPSSLSASVGDRVTITCQASQSVRYNVEWYQQKPGKAPKLLIYYASNRYTGVPSRFSGSGSGTDFTFTISSLQPEDIATYFCQHHYSSPLTFGGGTKLEIK

SEQ ID NO: 838 - protein, 107 aa, synthetic construct
  REGION 1..107: note = >Tgex 207B7huVL3_G34D56H90S93
SIQMTQSPSSLSASVGDRVTITCQASQSVRYNVGWYQQKPGKAPKLLIYYASNRYDGVPSRFSGSGSGTDFTFTISSLQPEDIATYFCQHHYSSPLTFGGGTKLEIK

SEQ ID NO: 839 - protein, 107 aa, synthetic construct
  REGION 1..107: note = >Tgex 207B7huVL3_G34D56Y87H90S93
SIQMTQSPSSLSASVGDRVTITCQASQSVRYNVGWYQQKPGKAPKLLIYYASNRYDGVPSRFSGSGSGTDFTFTISSLQPEDIATYYCQHHYSSPLTFGGGTKLEIK

SEQ ID NO: 840 - protein, 107 aa, synthetic construct
  REGION 1..107: note = >Tgex 207B7huVL3_G34E56H90S93
SIQMTQSPSSLSASVGDRVTITCQASQSVRYNVGWYQQKPGKAPKLLIYYASNRYEGVPSRFSGSGSGTDFTFTISSLQPEDIATYFCQHHYSSPLTFGGGTKLEIK

SEQ ID NO: 841 - protein, 107 aa, synthetic construct
  REGION 1..107: note = >Tgex 207B7huVL3_G34E56Y87H90S93
SIQMTQSPSSLSASVGDRVTITCQASQSVRYNVGWYQQKPGKAPKLLIYYASNRYEGVPSRFSGSGSGTDFTFTISSLQPEDIATYYCQHHYSSPLTFGGGTKLEIK

SEQ ID NO: 842 - protein, 107 aa, synthetic construct
  REGION 1..107: note = >Hu-VL3_G34H90S93
SIQMTQSPSSLSASVGDRVTITCQASQSVRYNVGWYQQKPGKAPKLLIYYASNRYTGVPSRFSGSGSGTDFTFTISSLQPEDIATYFCQHHYSSPLTFGGGTKLEIK

SEQ ID NO: 843 - protein, 107 aa, synthetic construct
  REGION 1..107: note = >Tgex 207B7huVL3_G34Y87H90S93
SIQMTQSPSSLSASVGDRVTITCQASQSVRYNVGWYQQKPGKAPKLLIYYASNRYTGVPSRFSGSGSGTDFTFTISSLQPEDIATYYCQHHYSSPLTFGGGTKLEIK

SEQ ID NO: 844 - protein, 107 aa, synthetic construct
  REGION 1..107: note = >Hu-VL3_H34H90S93
SIQMTQSPSSLSASVGDRVTITCQASQSVRYNVHWYQQKPGKAPKLLIYYASNRYTGVPSRFSGSGSGTDFTFTISSLQPEDIATYFCQHHYSSPLTFGGGTKLEIK

SEQ ID NO: 845 - protein, 107 aa, synthetic construct
  REGION 1..107: note = >HuVL3_H90S93_A34N
SIQMTQSPSSLSASVGDRVTITCQASQSVRYNVNWYQQKPGKAPKLLIYYASNRYTGVPSRFSGSGSGTDFTFTISSLQPEDIATYFCQHHYSSPLTFGGGTKLEIK

SEQ ID NO: 846 - protein, 107 aa, synthetic construct
  REGION 1..107: note = >Hu-VL3_Q34H90S93
SIQMTQSPSSLSASVGDRVTITCQASQSVRYNVQWYQQKPGKAPKLLIYYASNRYTGVPSRFSGSGSGTDFTFTISSLQPEDIATYFCQHHYSSPLTFGGGTKLEIK

SEQ ID NO: 847 - protein, 107 aa, synthetic construct
  REGION 1..107: note = >Hu-VL3_S34H90S93
SIQMTQSPSSLSASVGDRVTITCQASQSVRYNVSWYQQKPGKAPKLLIYYASNRYTGVPSRFSGSGSGTDFTFTISSLQPEDIATYFCQHHYSSPLTFGGGTKLEIK

SEQ ID NO: 848 - protein, 107 aa, synthetic construct
  REGION 1..107: note = >Hu-VL3_T34H90S93
SIQMTQSPSSLSASVGDRVTITCQASQSVRYNVTWYQQKPGKAPKLLIYYASNRYTGVPSRFSGSGSGTDFTFTISSLQPEDIATYFCQHHYSSPLTFGGGTKLEIK

SEQ ID NO: 849 - protein, 107 aa, synthetic construct
  REGION 1..107: note = >Hu-VL3_Y34H90S93
SIQMTQSPSSLSASVGDRVTITCQASQSVRYNVYWYQQKPGKAPKLLIYYASNRYTGVPSRFSGSGSGTDFTFTISSLQPEDIATYFCQHHYSSPLTFGGGTKLEIK

SEQ ID NO: 850 - protein, 107 aa, synthetic construct
  REGION 1..107: note = >Hu-VL3_Y33H90S93
SIQMTQSPSSLSASVGDRVTITCQASQSVRYNYAWYQQKPGKAPKLLIYYASNRYTGVPSRFSGSGSGTDFTFTISSLQPEDIATYFCQHHYSSPLTFGGGTKLEIK

SEQ ID NO: 851 - protein, 107 aa, synthetic construct
  REGION 1..107: note = >Hu-VL3_Q32H90S93
SIQMTQSPSSLSASVGDRVTITCQASQSVRYQVAWYQQKPGKAPKLLIYYASNRYTGVPSRFSGSGSGTDFTFTISSLQPEDIATYFCQHHYSSPLTFGGGTKLEIK

SEQ ID NO: 852 - protein, 107 aa, synthetic construct
  REGION 1..107: note = >Hu-VL3_S32H90S93
SIQMTQSPSSLSASVGDRVTITCQASQSVRYSVAWYQQKPGKAPKLLIYYASNRYTGVPSRFSGSGSGTDFTFTISSLQPEDIATYFCQHHYSSPLTFGGGTKLEIK

SEQ ID NO: 853 - protein, 107 aa, synthetic construct
  REGION 1..107: note = >Hu-VL3_T32H90S93
SIQMTQSPSSLSASVGDRVTITCQASQSVRYTVAWYQQKPGKAPKLLIYYASNRYTGVPSRFSGSGSGTDFTFTISSLQPEDIATYFCQHHYSSPLTFGGGTKLEIK

SEQ ID NO: 854 - protein, 107 aa, synthetic construct
  REGION 1..107: note = >Hu-VL3_W32H90S93
SIQMTQSPSSLSASVGDRVTITCQASQSVRYWVAWYQQKPGKAPKLLIYYASNRYTGVPSRFSGSGSGTDFTFTISSLQPEDIATYFCQHHYSSPLTFGGGTKLEIK

SEQ ID NO: 855 - protein, 107 aa, synthetic construct
  REGION 1..107: note = >HuVL3_H90S93_N32Y
SIQMTQSPSSLSASVGDRVTITCQASQSVRYYVAWYQQKPGKAPKLLIYYASNRYTGVPSRFSGSGSGTDFTFTISSLQPEDIATYFCQHHYSSPLTFGGGTKLEIK

SEQ ID NO: 856 - protein, 107 aa, synthetic construct
  REGION 1..107: note = >HuVL3_H90S93_R30S
SIQMTQSPSSLSASVGDRVTITCQASQSVSYNVAWYQQKPGKAPKLLIYYASNRYTGVPSRFSGSGSGTDFTFTISSLQPEDIATYFCQHHYSSPLTFGGGTKLEIK

SEQ ID NO: 857 - protein, 107 aa, synthetic construct
  REGION 1..107: note = >Hu-VL3_T30H90S93
SIQMTQSPSSLSASVGDRVTITCQASQSVTYNVAWYQQKPGKAPKLLIYYASNRYTGVPSRFSGSGSGTDFTFTISSLQPEDIATYFCQHHYSSPLTFGGGTKLEIK

SEQ ID NO: 858 - protein, 107 aa, synthetic construct
  REGION 1..107: note = >Hu-VL3_V30H90S93
SIQMTQSPSSLSASVGDRVTITCQASQSVVYNVAWYQQKPGKAPKLLIYYASNRYTGVPSRFSGSGSGTDFTFTISSLQPEDIATYFCQHHYSSPLTFGGGTKLEIK

SEQ ID NO: 859 - protein, 107 aa, synthetic construct
  REGION 1..107: note = >Hu-VL3_Y30H90S93
SIQMTQSPSSLSASVGDRVTITCQASQSVYYNVAWYQQKPGKAPKLLIYYASNRYTGVPSRFSGSGSGTDFTFTISSLQPEDIATYFCQHHYSSPLTFGGGTKLEIK

SEQ ID NO: 860 - protein, 107 aa, synthetic construct
  REGION 1..107: note = >Hu-VL3_T28H90S93
SIQMTQSPSSLSASVGDRVTITCQASQTVRYNVAWYQQKPGKAPKLLIYYASNRYTGVPSRFSGSGSGTDFTFTISSLQPEDIATYFCQHHYSSPLTFGGGTKLEIK

SEQ ID NO: 861 - protein, 107 aa, synthetic construct
  REGION 1..107: note = >Hu-VL3_V28H90S93
SIQMTQSPSSLSASVGDRVTITCQASQVVRYNVAWYQQKPGKAPKLLIYYASNRYTGVPSRFSGSGSGTDFTFTISSLQPEDIATYFCQHHYSSPLTFGGGTKLEIK

SEQ ID NO: 862 - protein, 107 aa, synthetic construct
  REGION 1..107: note = >Hu-VL3_Y28H90S93
SIQMTQSPSSLSASVGDRVTITCQASQYVRYNVAWYQQKPGKAPKLLIYYASNRYTGVPSRFSGSGSGTDFTFTISSLQPEDIATYFCQHHYSSPLTFGGGTKLEIK

SEQ ID NO: 863 - protein, 107 aa, synthetic construct
  REGION 1..107: note = >Hu-VL3_T26H90S93
SIQMTQSPSSLSASVGDRVTITCQATQSVRYNVAWYQQKPGKAPKLLIYYASNRYTGVPSRFSGSGSGTDFTFTISSLQPEDIATYFCQHHYSSPLTFGGGTKLEIK

SEQ ID NO: 864 - protein, 107 aa, synthetic construct
  REGION 1..107: note = >Hu-VL3_G25H90S93
SIQMTQSPSSLSASVGDRVTITCQGSQSVRYNVAWYQQKPGKAPKLLIYYASNRYTGVPSRFSGSGSGTDFTFTISSLQPEDIATYFCQHHYSSPLTFGGGTKLEIK

SEQ ID NO: 865 - protein, 107 aa, synthetic construct
  REGION 1..107: note = >Hu-VL3_L25H90S93
SIQMTQSPSSLSASVGDRVTITCQLSQSVRYNVAWYQQKPGKAPKLLIYYASNRYTGVPSRFSGSGSGTDFTFTISSLQPEDIATYFCQHHYSSPLTFGGGTKLEIK

SEQ ID NO: 866 - protein, 107 aa, synthetic construct
  REGION 1..107: note = >Hu-VL3_R25H90S93
SIQMTQSPSSLSASVGDRVTITCQRSQSVRYNVAWYQQKPGKAPKLLIYYASNRYTGVPSRFSGSGSGTDFTFTISSLQPEDIATYFCQHHYSSPLTFGGGTKLEIK

SEQ ID NO: 867 - protein, 107 aa, synthetic construct
  REGION 1..107: note = >Hu-VL3_S25H90S93
SIQMTQSPSSLSASVGDRVTITCQSSQSVRYNVAWYQQKPGKAPKLLIYYASNRYTGVPSRFSGSGSGTDFTFTISSLQPEDIATYFCQHHYSSPLTFGGGTKLEIK

SEQ ID NO: 868 - protein, 107 aa, synthetic construct
  REGION 1..107: note = >Hu-VL3_T25H90S93
SIQMTQSPSSLSASVGDRVTITCQTSQSVRYNVAWYQQKPGKAPKLLIYYASNRYTGVPSRFSGSGSGTDFTFTISSLQPEDIATYFCQHHYSSPLTFGGGTKLEIK

SEQ ID NO: 869 - protein, 107 aa, synthetic construct
  REGION 1..107: note = >Hu-VL3_R24H90S93
SIQMTQSPSSLSASVGDRVTITCRASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 870 - protein, 107 aa, synthetic construct
  REGION 1..107: note = >Hu-VL3_S24H90S93
SIQMTQSPSSLSASVGDRVTITCSASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 871 - protein, 107 aa, synthetic construct
  REGION 1..107: note = >Hu-VL3_T24H90S93
SIQMTQSPSSLSASVGDRVTITCTASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 872 - protein, 107 aa, synthetic construct; identical to SEQ ID NO: 26
  REGION 1..107: note = >TGEX-LC Human Kappa 207B7 germline

SEQ ID NO: 873 - protein, 107 aa, synthetic construct
  REGION 1..107: note = >TGEX-LC Human Kappa 207B7 germline 169A1 CDRs
SIVMTQTPKFLPVSAGDRVTMTCKASQSVGYNVAWYQQKPGQSPKLLIYYASNRYTGVPDRFTGSGSGTDFTFTISSVQVEDLAVYFCQHHYSSPLTFGAGTKLELK

SEQ ID NO: 874 - protein, 107 aa, synthetic construct
  REGION 1..107: note = >TGEX-LC Human Kappa 207B7 169A1 LCA
SIVMTQTPKFLPVSAGDRVTMTCKASQSVGYNVAWYQQKPGQSPKLLIYYASNRYTGVPDRFTGSGSGTDFTFTISSVQVEDLAVYFCQQHYSSPLTFGAGTKLELK

SEQ ID NO: 875 - protein, 107 aa, synthetic construct; identical to SEQ ID NO: 30
  REGION 1..107: note = >TGEX-LC Human Kappa 169A1

SEQ ID NO: 876 - protein, 107 aa, synthetic construct; identical to SEQ ID NO: 31
  REGION 1..107: note = >TGEX-LC Human Kappa 207B7mGF Q90H (was previously 207B7 germline207B7 169A1 CDRs)

SEQ ID NO: 877 - protein, 107 aa, synthetic construct; identical to SEQ ID NO: 28
  REGION 1..107: note = >TGEX-LC Human Kappa 207B7 germline 207B7 CDRs

SEQ ID NO: 878 - protein, 107 aa, synthetic construct; identical to SEQ ID NO: 24
  REGION 1..107: note = >TGEX-LC Human Kappa 207B7 (LPAR1)

SEQ ID NO: 879 - protein, 107 aa, synthetic construct
  REGION 1..107: note = >HuVL3_H90S93_S1A
AIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 880 - protein, 107 aa, synthetic construct; identical to SEQ ID NO: 39
  REGION 1..107: note = >huVL3_Q90H_S93_VL

SEQ ID NO: 881 - protein, 107 aa, synthetic construct
  REGION 1..107: note = >HuVL3_H90S93_S1N
NIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 882 - protein, 107 aa, synthetic construct
  REGION 1..107: note = >HuVL3_H90S93_S1E
EIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 883 - protein, 107 aa, synthetic construct
  REGION 1..107: note = >HuVL3_H90S93_S1Q
QIQMTQSPSSLSASVGDRVTITCQASQSVRYNVAWYQQKPGKAPKLLIYYASNRYTGVPSRFSGSGSGTDFTFTISSLQPEDIATYFCQHHYSSPLTFGGGTKLEIK

SEQ ID NO: 884 - protein, 107 aa, synthetic construct
  REGION 1..107: note = >AA_huVL3_Q90H_VL
SIQMTQSPSSLSASVGDRVTITCQASQSVRYNVAWYQQKPGKAPKLLIYYASNRYTGVPSRFSGSGSGTDFTFTISSLQPEDIATYFCQHHYNSPLTFGGGTKLEIK

SEQ ID NO: 885 - protein, 107 aa, synthetic construct; identical to SEQ ID NO: 34
  REGION 1..107: note = >AA_207B7_huVL3_VL

SEQ ID NO: 886 - protein, 107 aa, synthetic construct
  REGION 1..107: note = >huVL3_S93_VL
SIQMTQSPSSLSASVGDRVTITCQASQSVRYNVAWYQQKPGKAPKLLIYYASNRYTGVPSRFSGSGSGTDFTFTISSLQPEDIATYFCQQHYSSPLTFGGGTKLEIK

SEQ ID NO: 887 - protein, 107 aa, synthetic construct
  REGION 1..107: note = >HuVL3_H90S93_Q27E
SIQMTQSPSSLSASVGDRVTITCQASESVRYNVAWYQQKPGKAPKLLIYYASNRYTGVPSRFSGSGSGTDFTFTISSLQPEDIATYFCQHHYSSPLTFGGGTKLEIK

SEQ ID NO: 888 - protein, 107 aa, synthetic construct
  REGION 1..107: note = >HuVL3_H90S93_Q27K
SIQMTQSPSSLSASVGDRVTITCQASKSVRYNVAWYQQKPGKAPKLLIYYASNRYTGVPSRFSGSGSGTDFTFTISSLQPEDIATYFCQHHYSSPLTFGGGTKLEIK

SEQ ID NO: 889 - protein, 107 aa, synthetic construct
  REGION 1..107: note = >HuVL3_H90S93_Q27L
SIQMTQSPSSLSASVGDRVTITCQASLSVRYNVAWYQQKPGKAPKLLIYYASNRYTGVPSRFSGSGSGTDFTFTISSLQPEDIATYFCQHHYSSPLTFGGGTKLEIK

SEQ ID NO: 890 - protein, 107 aa, synthetic construct
  REGION 1..107: note = >HuVL3_H90S93_Q27M
SIQMTQSPSSLSASVGDRVTITCQASMSVRYNVAWYQQKPGKAPKLLIYYASNRYTGVPSRFSGSGSGTDFTFTISSLQPEDIATYFCQHHYSSPLTFGGGTKLEIK

SEQ ID NO: 891 - protein, 107 aa, synthetic construct
  REGION 1..107: note = >HuVL3_H90S93_Q27V
SIQMTQSPSSLSASVGDRVTITCQASVSVRYNVAWYQQKPGKAPKLLIYYASNRYTGVPSRFSGSGSGTDFTFTISSLQPEDIATYFCQHHYSSPLTFGGGTKLEIK

SEQ ID NO: 892 - protein, 107 aa, synthetic construct
  REGION 1..107: note = >HuVL3_H90S93_Q27W
SIQMTQSPSSLSASVGDRVTITCQASWSVRYNVAWYQQKPGKAPKLLIYYASNRYTGVPSRFSGSGSGTDFTFTISSLQPEDIATYFCQHHYSSPLTFGGGTKLEIK

SEQ ID NO: 893 - protein, 107 aa, synthetic construct
  REGION 1..107: note = >HuVL3_H90S93_Q27A
SIQMTQSPSSLSASVGDRVTITCQASASVRYNVAWYQQKPGKAPKLLIYYASNRYTGVPSRFSGSGSGTDFTFTISSLQPEDIATYFCQHHYSSPLTFGGGTKLEIK

SEQ ID NO: 894 - protein, 107 aa, synthetic construct
  REGION 1..107: note = >HuVL3_H90S93_Q27D
SIQMTQSPSSLSASVGDRVTITCQASDSVRYNVAWYQQKPGKAPKLLIYYASNRYTGVPSRFSGSGSGTDFTFTISSLQPEDIATYFCQHHYSSPLTFGGGTKLEIK

SEQ ID NO: 895 - protein, 107 aa, synthetic construct
  REGION 1..107: note = >HuVL3_H90S93_Q27F
SIQMTQSPSSLSASVGDRVTITCQASFSVRYNVAWYQQKPGKAPKLLIYYASNRYTGVPSRFSGSGSGTDFTFTISSLQPEDIATYFCQHHYSSPLTFGGGTKLEIK

SEQ ID NO: 896 - protein, 107 aa, synthetic construct
  REGION 1..107: note = >HuVL3_H90S93_Q27G
SIQMTQSPSSLSASVGDRVTITCQASGSVRYNVAWYQQKPGKAPKLLIYYASNRYTGVPSRFSGSGSGTDFTFTISSLQPEDIATYFCQHHYSSPLTFGGGTKLEIK

SEQ ID NO: 897 - protein, 107 aa, synthetic construct
  REGION 1..107: note = >HuVL3_H90S93_Q27H
SIQMTQSPSSLSASVGDRVTITCQASHSVRYNVAWYQQKPGKAPKLLIYYASNRYTGVPSRFSGSGSGTDFTFTISSLQPEDIATYFCQHHYSSPLTFGGGTKLEIK

SEQ ID NO: 898 - protein, 107 aa, synthetic construct
  REGION 1..107: note = >HuVL3_H90S93_Q27I
SIQMTQSPSSLSASVGDRVTITCQASISVRYNVAWYQQKPGKAPKLLIYYASNRYTGVPSRFSGSGSGTDFTFTISSLQPEDIATYFCQHHYSSPLTFGGGTKLEIK

SEQ ID NO: 899 - protein, 107 aa, synthetic construct
  REGION 1..107: note = >HuVL3_H90S93_Q27N
SIQMTQSPSSLSASVGDRVTITCQASNSVRYNVAWYQQKPGKAPKLLIYYASNRYTGVPSRFSGSGSGTDFTFTISSLQPEDIATYFCQHHYSSPLTFGGGTKLEIK

SEQ ID NO: 900 - protein, 107 aa, synthetic construct
  REGION 1..107: note = >HuVL3_H90S93_Q27P
SIQMTQSPSSLSASVGDRVTITCQASPSVRYNVAWYQQKPGKAPKLLIYYASNRYTGVPSRFSGSGSGTDFTFTISSLQPEDIATYFCQHHYSSPLTFGGGTKLEIK

SEQ ID NO: 901 - protein, 107 aa, synthetic construct
  REGION 1..107: note = >HuVL3_H90S93_Q27R
SIQMTQSPSSLSASVGDRVTITCQASRSVRYNVAWYQQKPGKAPKLLIYYASNRYTGVPSRFSGSGSGTDFTFTISSLQPEDIATYFCQHHYSSPLTFGGGTKLEIK

SEQ ID NO: 902 - protein, 107 aa, synthetic construct
  REGION 1..107: note = >HuVL3_H90S93_Q27S
SIQMTQSPSSLSASVGDRVTITCQASSSVRYNVAWYQQKPGKAPKLLIYYASNRYTGVPSRFSGSGSGTDFTFTISSLQPEDIATYFCQHHYSSPLTFGGGTKLEIK

SEQ ID NO: 903 - protein, 107 aa, synthetic construct
  REGION 1..107: note = >HuVL3_H90S93_Q27T
SIQMTQSPSSLSASVGDRVTITCQASTSVRYNVAWYQQKPGKAPKLLIYYASNRYTGVPSRFSGSGSGTDFTFTISSLQPEDIATYFCQHHYSSPLTFGGGTKLEIK

SEQ ID NO: 904 - protein, 107 aa, synthetic construct
  REGION 1..107: note = >HuVL3_H90S93_Q27Y
SIQMTQSPSSLSASVGDRVTITCQASYSVRYNVAWYQQKPGKAPKLLIYYASNRYTGVPSRFSGSGSGTDFTFTISSLQPEDIATYFCQHHYSSPLTFGGGTKLEIK

SEQ ID NO: 905 - protein, 107 aa, synthetic construct
  REGION 1..107: note = >HuVL3_H90S93_Y31D
SIQMTQSPSSLSASVGDRVTITCQASQSVRDNVAWYQQKPGKAPKLLIYYASNRYTGVPSRFSGSGSGTDFTFTISSLQPEDIATYFCQHHYSSPLTFGGGTKLEIK

SEQ ID NO: 906 - protein, 107 aa, synthetic construct
  REGION 1..107: note = >HuVL3_H90S93_Y31H
SIQMTQSPSSLSASVGDRVTITCQASQSVRHNVAWYQQKPGKAPKLLIYYASNRYTGVPSRFSGSGSGTDFTFTISSLQPEDIATYFCQHHYSSPLTFGGGTKLEIK

SEQ ID NO: 907 - protein, 107 aa, synthetic construct
  REGION 1..107: note = >HuVL3_H90S93_Y31F
SIQMTQSPSSLSASVGDRVTITCQASQSVRFNVAWYQQKPGKAPKLLIYYASNRYTGVPSRFSGSGSGTDFTFTISSLQPEDIATYFCQHHYSSPLTFGGGTKLEIK

SEQ ID NO: 908 - protein, 107 aa, synthetic construct
  REGION 1..107: note = >HuVL3_H90S93_Y31G
SIQMTQSPSSLSASVGDRVTITCQASQSVRGNVAWYQQKPGKAPKLLIYYASNRYTGVPSRFSGSGSGTDFTFTISSLQPEDIATYFCQHHYSSPLTFGGGTKLEIK

SEQ ID NO: 909 - protein, 107 aa, synthetic construct
  REGION 1..107: note = >HuVL3_H90S93_Y31I
SIQMTQSPSSLSASVGDRVTITCQASQSVRINVAWYQQKPGKAPKLLIYYASNRYTGVPSRFSGSGSGTDFTFTISSLQPEDIATYFCQHHYSSPLTFGGGTKLEIK

SEQ ID NO: 910 - protein, 107 aa, synthetic construct
  REGION 1..107: note = >HuVL3_H90S93_Y31P
SIQMTQSPSSLSASVGDRVTITCQASQSVRPNVAWYQQKPGKAPKLLIYYASNRYTGVPSRFSGSGSGTDFTFTISSLQPEDIATYFCQHHYSSPLTFGGGTKLEIK

SEQ ID NO: 911 - protein, 107 aa, synthetic construct
  REGION 1..107: note = >HuVL3_H90S93_Y31S
SIQMTQSPSSLSASVGDRVTITCQASQSVRSNVAWYQQKPGKAPKLLIYYASNRYTGVPSRFSGSGSGTDFTFTISSLQPEDIATYFCQHHYSSPLTFGGGTKLEIK

SEQ ID NO: 912 - protein, 107 aa, synthetic construct
  REGION 1..107: note = >HuVL3_H90S93_Y31T
SIQMTQSPSSLSASVGDRVTITCQASQSVRTNVAWYQQKPGKAPKLLIYYASNRYTGVPSRFSGSGSGTDFTFTISSLQPEDIATYFCQHHYSSPLTFGGGTKLEIK

SEQ ID NO: 913 - protein, 107 aa, synthetic construct
  REGION 1..107: note = >HuVL3_H90S93_Y31E
SIQMTQSPSSLSASVGDRVTITCQASQSVRENVAWYQQKPGKAPKLLIYYASNRYTGVPSRFSGSGSGTDFTFTISSLQPEDIATYFCQHHYSSPLTFGGGTKLEIK

SEQ ID NO: 914 - protein, 107 aa, synthetic construct
  REGION 1..107: note = >HuVL3_H90S93_Y31K
SIQMTQSPSSLSASVGDRVTITCQASQSVRKNVAWYQQKPGKAPKLLIYYASNRYTGVPSRFSGSGSGTDFTFTISSLQPEDIATYFCQHHYSSPLTFGGGTKLEIK

SEQ ID NO: 915 - protein, 107 aa, synthetic construct
  REGION 1..107: note = >HuVL3_H90S93_Y31L
SIQMTQSPSSLSASVGDRVTITCQASQSVRLNVAWYQQKPGKAPKLLIYYASNRYTGVPSRFSGSGSGTDFTFTISSLQPEDIATYFCQHHYSSPLTFGGGTKLEIK

SEQ ID NO: 916 - protein, 107 aa, synthetic construct
  REGION 1..107: note = >HuVL3_H90S93_Y31M
SIQMTQSPSSLSASVGDRVTITCQASQSVRMNVAWYQQKPGKAPKLLIYYASNRYTGVPSRFSGSGSGTDFTFTISSLQPEDIATYFCQHHYSSPLTFGGGTKLEIK

SEQ ID NO: 917 - protein, 107 aa, synthetic construct
  REGION 1..107: note = >HuVL3_H90S93_Y31Q
SIQMTQSPSSLSASVGDRVTITCQASQSVRQNVAWYQQKPGKAPKLLIYYASNRYTGVPSRFSGSGSGTDFTFTISSLQPEDIATYFCQHHYSSPLTFGGGTKLEIK

SEQ ID NO: 918 - protein, 107 aa, synthetic construct
  REGION 1..107: note = >HuVL3_H90S93_Y31R
SIQMTQSPSSLSASVGDRVTITCQASQSVRRNVAWYQQKPGKAPKLLIYYASNRYTGVPSRFSGSGSGTDFTFTISSLQPEDIATYFCQHHYSSPLTFGGGTKLEIK

SEQ ID NO: 919 - protein, 107 aa, synthetic construct
  REGION 1..107: note = >HuVL3_H90S93_Y31V
SIQMTQSPSSLSASVGDRVTITCQASQSVRVNVAWYQQKPGKAPKLLIYYASNRYTGVPSRFSGSGSGTDFTFTISSLQPEDIATYFCQHHYSSPLTFGGGTKLEIK

SEQ ID NO: 920 - protein, 107 aa, synthetic construct
  REGION 1..107: note = >HuVL3_H90S93_Y31W
SIQMTQSPSSLSASVGDRVTITCQASQSVRWNVAWYQQKPGKAPKLLIYYASNRYTGVPSRFSGSGSGTDFTFTISSLQPEDIATYFCQHHYSSPLTFGGGTKLEIK

SEQ ID NO: 921 - protein, 107 aa, synthetic construct
  REGION 1..107: note = >HuVL3_H90S93_Y50E
SIQMTQSPSSLSASVGDRVTITCQASQSVRYNVAWYQQKPGKAPKLLIYEASNRYTGVPSRFSGSGSGTDFTFTISSLQPEDIATYFCQHHYSSPLTFGGGTKLEIK

SEQ ID NO: 922 - protein, 107 aa, synthetic construct
  REGION 1..107: note = >HuVL3_H90S93_Y50F
SIQMTQSPSSLSASVGDRVTITCQASQSVRYNVAWYQQKPGKAPKLLIYFASNRYTGVPSRFSGSGSGTDFTFTISSLQPEDIATYFCQHHYSSPLTFGGGTKLEIK

SEQ ID NO: 923 - protein, 107 aa, synthetic construct
  REGION 1..107: note = >HuVL3_H90S93_Y50G
SIQMTQSPSSLSASVGDRVTITCQASQSVRYNVAWYQQKPGKAPKLLIYGASNRYTGVPSRFSGSGSGTDFTFTISSLQPEDIATYFCQHHYSSPLTFGGGTKLEIK

SEQ ID NO: 924 - protein, 107 aa, synthetic construct
  REGION 1..107: note = >HuVL3_H90S93_Y50H
SIQMTQSPSSLSASVGDRVTITCQASQSVRYNVAWYQQKPGKAPKLLIYHASNRYTGVPSRFSGSGSGTDFTFTISSLQPEDIATYFCQHHYSSPLTFGGGTKLEIK

SEQ ID NO: 925 - protein, 107 aa, synthetic construct
  REGION 1..107: note = >HuVL3_H90S93_Y50I
SIQMTQSPSSLSASVGDRVTITCQASQSVRYNVAWYQQKPGKAPKLLIYIASNRYTGVPSRFSGSGSGTDFTFTISSLQPEDIATYFCQHHYSSPLTFGGGTKLEIK

SEQ ID NO: 926 - protein, 107 aa, synthetic construct
  REGION 1..107: note = >HuVL3_H90S93_Y50K
SIQMTQSPSSLSASVGDRVTITCQASQSVRYNVAWYQQKPGKAPKLLIYKASNRYTGVPSRFSGSGSGTDFTFTISSLQPEDIATYFCQHHYSSPLTFGGGTKLEIK

SEQ ID NO: 927 - protein, 107 aa, synthetic construct
  REGION 1..107: note = >HuVL3_H90S93_Y50L
SIQMTQSPSSLSASVGDRVTITCQASQSVRYNVAWYQQKPGKAPKLLIYLASNRYTGVPSRFSGSGSGTDFTFTISSLQPEDIATYFCQHHYSSPLTFGGGTKLEIK

SEQ ID NO: 928 - protein, 107 aa, synthetic construct
  REGION 1..107: note = >HuVL3_H90S93_Y50M
SIQMTQSPSSLSASVGDRVTITCQASQSVRYNVAWYQQKPGKAPKLLIYMASNRYTGVPSRFSGSGSGTDFTFTISSLQPEDIATYFCQHHYSSPLTFGGGTKLEIK

SEQ ID NO: 929 - protein, 107 aa, synthetic construct
  REGION 1..107: note = >HuVL3_H90S93_Y50N
SIQMTQSPSSLSASVGDRVTITCQASQSVRYNVAWYQQKPGKAPKLLIYNASNRYTGVPSRFSGSGSGTDFTFTISSLQPEDIATYFCQHHYSSPLTFGGGTKLEIK

SEQ ID NO: 930 - protein, 107 aa, synthetic construct
  REGION 1..107: note = >HuVL3_H90S93_Y50P
SIQMTQSPSSLSASVGDRVTITCQASQSVRYNVAWYQQKPGKAPKLLIYPASNRYTGVPSRFSGSGSGTDFTFTISSLQPEDIATYFCQHHYSSPLTFGGGTKLEIK

SEQ ID NO: 931 - protein, 107 aa, synthetic construct
  REGION 1..107: note = >HuVL3_H90S93_Y50Q
SIQMTQSPSSLSASVGDRVTITCQASQSVRYNVAWYQQKPGKAPKLLIYQASNRYTGVPSRFSGSGSGTDFTFTISSLQPEDIATYFCQHHYSSPLTFGGGTKLEIK

SEQ ID NO: 932 - protein, 107 aa, synthetic construct
  REGION 1..107: note = >HuVL3_H90S93_Y50R
SIQMTQSPSSLSASVGDRVTITCQASQSVRYNVAWYQQKPGKAPKLLIYRASNRYTGVPSRFSGSGSGTDFTFTISSLQPEDIATYFCQHHYSSPLTFGGGTKLEIK

SEQ ID NO: 933 - protein, 107 aa, synthetic construct
  REGION 1..107: note = >HuVL3_H90S93_Y50S
SIQMTQSPSSLSASVGDRVTITCQASQSVRYNVAWYQQKPGKAPKLLIYSASNRYTGVPSRFSGSGSGTDFTFTISSLQPEDIATYFCQHHYSSPLTFGGGTKLEIK

SEQ ID NO: 934 - protein, 107 aa, synthetic construct
  REGION 1..107: note = >HuVL3_H90S93_Y50T
SIQMTQSPSSLSASVGDRVTITCQASQSVRYNVAWYQQKPGKAPKLLIYTASNRYTGVPSRFSGSGSGTDFTFTISSLQPEDIATYFCQHHYSSPLTFGGGTKLEIK

SEQ ID NO: 935 - protein, 107 aa, synthetic construct
  REGION 1..107: note = >HuVL3_H90S93_Y50V
SIQMTQSPSSLSASVGDRVTITCQASQSVRYNVAWYQQKPGKAPKLLIYVASNRYTGVPSRFSGSGSGTDFTFTISSLQPEDIATYFCQHHYSSPLTFGGGTKLEIK

SEQ ID NO: 936 - protein, 107 aa, synthetic construct
  REGION 1..107: note = >HuVL3_H90S93_Y50W
SIQMTQSPSSLSASVGDRVTITCQASQSVRYNVAWYQQKPGKAPKLLIYWASNRYTGVPSRFSGSGSGTDFTFTISSLQPEDIATYFCQHHYSSPLTFGGGTKLEIK

SEQ ID NO: 937 - protein, 107 aa, synthetic construct
  REGION 1..107: note = >HuVL3_H90S93_S52G
SIQMTQSPSSLSASVGDRVTITCQASQSVRYNVAWYQQKPGKAPKLLIYYAGNRYTGVPSRFSGSGSGTDFTFTISSLQPEDIATYFCQHHYSSPLTFGGGTKLEIK

SEQ ID NO: 938 - protein, 107 aa, synthetic construct
  REGION 1..107: note = >HuVL3_H90S93_S52D
SIQMTQSPSSLSASVGDRVTITCQASQSVRYNVAWYQQKPGKAPKLLIYYADNRYTGVPSRFSGSGSGTDFTFTISSLQPEDIATYFCQHHYSSPLTFGGGTKLEIK

SEQ ID NO: 939 - protein, 107 aa, synthetic construct
  REGION 1..107: note = >HuVL3_H90S93_S52F
SIQMTQSPSSLSASVGDRVTITCQASQSVRYNVAWYQQKPGKAPKLLIYYAFNRYTGVPSRFSGSGSGTDFTFTISSLQPEDIATYFCQHHYSSPLTFGGGTKLEIK

SEQ ID NO: 940 - protein, 107 aa, synthetic construct
  REGION 1..107: note = >HuVL3_H90S93_S52H
SIQMTQSPSSLSASVGDRVTITCQASQSVRYNVAWYQQKPGKAPKLLIYYAHNRYTGVPSRFSGSGSGTDFTFTISSLQPEDIATYFCQHHYSSPLTFGGGTKLEIK

SEQ ID NO: 941 - protein, 107 aa, synthetic construct
  REGION 1..107: note = >HuVL3_H90S93_S52I
SIQMTQSPSSLSASVGDRVTITCQASQSVRYNVAWYQQKPGKAPKLLIYYAINRYTGVPSRFSGSGSGTDFTFTISSLQPEDIATYFCQHHYSSPLTFGGGTKLEIK

SEQ ID NO: 942 - protein, 107 aa, synthetic construct
  REGION 1..107: note = >HuVL3_H90S93_S52N
SIQMTQSPSSLSASVGDRVTITCQASQSVRYNVAWYQQKPGKAPKLLIYYANNRYTGVPSRFSGSGSGTDFTFTISSLQPEDIATYFCQHHYSSPLTFGGGTKLEIK

SEQ ID NO: 943 - protein, 107 aa, synthetic construct
  REGION 1..107: note = >HuVL3_H90S93_S52P
SIQMTQSPSSLSASVGDRVTITCQASQSVRYNVAWYQQKPGKAPKLLIYYAPNRYTGVPSRFSGSGSGTDFTFTISSLQPEDIATYFCQHHYSSPLTFGGGTKLEIK

SEQ ID NO: 944 - protein, 107 aa, synthetic construct
  REGION 1..107: note = >HuVL3_H90S93_S52T
SIQMTQSPSSLSASVGDRVTITCQASQSVRYNVAWYQQKPGKAPKLLIYYATNRYTGVPSRFSGSGSGTDFTFTISSLQPEDIATYFCQHHYSSPLTFGGGTKLEIK

SEQ ID NO: 945 - protein, 107 aa, synthetic construct
  REGION 1..107: note = >HuVL3_H90S93_S52Y
SIQMTQSPSSLSASVGDRVTITCQASQSVRYNVAWYQQKPGKAPKLLIYYAYNRYTGVPSRFSGSGSGTDFTFTISSLQPEDIATYFCQHHYSSPLTFGGGTKLEIK

SEQ ID NO: 946 - protein, 107 aa, synthetic construct
  REGION 1..107: note = >HuVL3_H90S93_T56I
SIQMTQSPSSLSASVGDRVTITCQASQSVRYNVAWYQQKPGKAPKLLIYYASNRYIGVPSRFSGSGSGTDFTFTISSLQPEDIATYFCQHHYSSPLTFGGGTKLEIK

SEQ ID NO: 947 - protein, 107 aa, synthetic construct
  REGION 1..107: note = >HuVL3_H90S93_T56K
SIQMTQSPSSLSASVGDRVTITCQASQSVRYNVAWYQQKPGKAPKLLIYYASNRYKGVPSRFSGSGSGTDFTFTISSLQPEDIATYFCQHHYSSPLTFGGGTKLEIK

SEQ ID NO: 948 - protein, 107 aa, synthetic construct
  REGION 1..107: note = >HuVL3_H90S93_T56M
SIQMTQSPSSLSASVGDRVTITCQASQSVRYNVAWYQQKPGKAPKLLIYYASNRYMGVPSRFSGSGSGTDFTFTISSLQPEDIATYFCQHHYSSPLTFGGGTKLEIK

SEQ ID NO: 949 - protein, 107 aa, synthetic construct
  REGION 1..107: note = >HuVL3_H90S93_T56N
SIQMTQSPSSLSASVGDRVTITCQASQSVRYNVAWYQQKPGKAPKLLIYYASNRYNGVPSRFSGSGSGTDFTFTISSLQPEDIATYFCQHHYSSPLTFGGGTKLEIK

SEQ ID NO: 950 - protein, 107 aa, synthetic construct
  REGION 1..107: note = >HuVL3_H90S93_T56R
SIQMTQSPSSLSASVGDRVTITCQASQSVRYNVAWYQQKPGKAPKLLIYYASNRYRGVPSRFSGSGSGTDFTFTISSLQPEDIATYFCQHHYSSPLTFGGGTKLEIK

SEQ ID NO: 951 - protein, 107 aa, synthetic construct
  REGION 1..107: note = >HuVL3_H90S93_S52E
SIQMTQSPSSLSASVGDRVTITCQASQSVRYNVAWYQQKPGKAPKLLIYYAENRYTGVPSRFSGSGSGTDFTFTISSLQPEDIATYFCQHHYSSPLTFGGGTKLEIK

SEQ ID NO: 952 - protein, 107 aa, synthetic construct
  REGION 1..107: note = >HuVL3_H90S93_S52K
SIQMTQSPSSLSASVGDRVTITCQASQSVRYNVAWYQQKPGKAPKLLIYYAKNRYTGVPSRFSGSGSGTDFTFTISSLQPEDIATYFCQHHYSSPLTFGGGTKLEIK

SEQ ID NO: 953 - protein, 107 aa, synthetic construct
  REGION 1..107: note = >HuVL3_H90S93_S52L
SIQMTQSPSSLSASVGDRVTITCQASQSVRYNVAWYQQKPGKAPKLLIYYALNRYTGVPSRFSGSGSGTDFTFTISSLQPEDIATYFCQHHYSSPLTFGGGTKLEIK

SEQ ID NO: 954 - protein, 107 aa, synthetic construct
  REGION 1..107: note = >HuVL3_H90S93_S52M
SIQMTQSPSSLSASVGDRVTITCQASQSVRYNVAWYQQKPGKAPKLLIYYAMNRYTGVPSRFSGSGSGTDFTFTISSLQPEDIATYFCQHHYSSPLTFGGGTKLEIK

SEQ ID NO: 955 - protein, 107 aa, synthetic construct
  REGION 1..107: note = >HuVL3_H90S93_S52Q
SIQMTQSPSSLSASVGDRVTITCQASQSVRYNVAWYQQKPGKAPKLLIYYAQNRYTGVPSRFSGSGSGTDFTFTISSLQPEDIATYFCQHHYSSPLTFGGGTKLEIK

SEQ ID NO: 956 - protein, 107 aa, synthetic construct
  REGION 1..107: note = >HuVL3_H90S93_S52R
SIQMTQSPSSLSASVGDRVTITCQASQSVRYNVAWYQQKPGKAPKLLIYYARNRYTGVPSRFSGSGSGTDFTFTISSLQPEDIATYFCQHHYSSPLTFGGGTKLEIK

SEQ ID NO: 957 - protein, 107 aa, synthetic construct
  REGION 1..107: note = >HuVL3_H90S93_S52V
SIQMTQSPSSLSASVGDRVTITCQASQSVRYNVAWYQQKPGKAPKLLIYYAVNRYTGVPSRFSGSGSGTDFTFTISSLQPEDIATYFCQHHYSSPLTFGGGTKLEIK

SEQ ID NO: 958 - protein, 107 aa, synthetic construct
  REGION 1..107: note = >HuVL3_H90S93_S52W
SIQMTQSPSSLSASVGDRVTITCQASQSVRYNVAWYQQKPGKAPKLLIYYAWNRYTGVPSRFSGSGSGTDFTFTISSLQPEDIATYFCQHHYSSPLTFGGGTKLEIK

SEQ ID NO: 959 - protein, 107 aa, synthetic construct
  REGION 1..107: note = >HuVL3_H90S93_Y55D
SIQMTQSPSSLSASVGDRVTITCQASQSVRYNVAWYQQKPGKAPKLLIYYASNRDTGVPSRFSGSGSGTDFTFTISSLQPEDIATYFCQHHYSSPLTFGGGTKLEIK

SEQ ID NO: 960 - protein, 107 aa, synthetic construct
  REGION 1..107: note = >HuVL3_H90S93_Y55H
SIQMTQSPSSLSASVGDRVTITCQASQSVRYNVAWYQQKPGKAPKLLIYYASNRHTGVPSRFSGSGSGTDFTFTISSLQPEDIATYFCQHHYSSPLTFGGGTKLEIK

SEQ ID NO: 961 - protein, 107 aa, synthetic construct
  REGION 1..107: note = >HuVL3_H90S93_Y55N
SIQMTQSPSSLSASVGDRVTITCQASQSVRYNVAWYQQKPGKAPKLLIYYASNRNTGVPSRFSGSGSGTDFTFTISSLQPEDIATYFCQHHYSSPLTFGGGTKLEIK

SEQ ID NO: 962 - protein, 107 aa, synthetic construct
  REGION 1..107: note = >HuVL3_H90S93_Y55F
SIQMTQSPSSLSASVGDRVTITCQASQSVRYNVAWYQQKPGKAPKLLIYYASNRFTGVPSRFSGSGSGTDFTFTISSLQPEDIATYFCQHHYSSPLTFGGGTKLEIK

SEQ ID NO: 963 - protein, 107 aa, synthetic construct
  REGION 1..107: note = >HuVL3_H90S93_Y55G
SIQMTQSPSSLSASVGDRVTITCQASQSVRYNVAWYQQKPGKAPKLLIYYASNRGTGVPSRFSGSGSGTDFTFTISSLQPEDIATYFCQHHYSSPLTFGGGTKLEIK

SEQ ID NO: 964 - protein, 107 aa, synthetic construct
  REGION 1..107: note = >HuVL3_H90S93_Y55I
SIQMTQSPSSLSASVGDRVTITCQASQSVRYNVAWYQQKPGKAPKLLIYYASNRITGVPSRFSGSGSGTDFTFTISSLQPEDIATYFCQHHYSSPLTFGGGTKLEIK

SEQ ID NO: 965 - protein, 107 aa, synthetic construct
  REGION 1..107: note = >HuVL3_H90S93_Y55P
SIQMTQSPSSLSASVGDRVTITCQASQSVRYNVAWYQQKPGKAPKLLIYYASNRPTGVPSRFSGSGSGTDFTFTISSLQPEDIATYFCQHHYSSPLTFGGGTKLEIK

SEQ ID NO: 966 - protein, 107 aa, synthetic construct
  REGION 1..107: note = >HuVL3_H90S93_Y55S
SIQMTQSPSSLSASVGDRVTITCQASQSVRYNVAWYQQKPGKAPKLLIYYASNRSTGVPSRFSGSGSGTDFTFTISSLQPEDIATYFCQHHYSSPLTFGGGTKLEIK

SEQ ID NO: 967 - protein, 107 aa, synthetic construct
  REGION 1..107: note = >HuVL3_H90S93_Y55T
SIQMTQSPSSLSASVGDRVTITCQASQSVRYNVAWYQQKPGKAPKLLIYYASNRTTGVPSRFSGSGSGTDFTFTISSLQPEDIATYFCQHHYSSPLTFGGGTKLEIK

SEQ ID NO: 968 - protein, 107 aa, synthetic construct
  REGION 1..107: note = >HuVL3_H90S93_Y55K
SIQMTQSPSSLSASVGDRVTITCQASQSVRYNVAWYQQKPGKAPKLLIYYASNRKTGVPSRFSGSGSGTDFTFTISSLQPEDIATYFCQHHYSSPLTFGGGTKLEIK

SEQ ID NO: 969 - protein, 107 aa, synthetic construct
  REGION 1..107: note = >HuVL3_H90S93_Y55L
SIQMTQSPSSLSASVGDRVTITCQASQSVRYNVAWYQQKPGKAPKLLIYYASNRLTGVPSRFSGSGSGTDFTFTISSLQPEDIATYFCQHHYSSPLTFGGGTKLEIK

SEQ ID NO: 970 - protein, 107 aa, synthetic construct
  REGION 1..107: note = >HuVL3_H90S93_Y55M
SIQMTQSPSSLSASVGDRVTITCQASQSVRYNVAWYQQKPGKAPKLLIYYASNRMTGVPSRFSGSGSGTDFTFTISSLQPEDIATYFCQHHYSSPLTFGGGTKLEIK

SEQ ID NO: 971 - protein, 107 aa, synthetic construct
  REGION 1..107: note = >HuVL3_H90S93_Y55Q
SIQMTQSPSSLSASVGDRVTITCQASQSVRYNVAWYQQKPGKAPKLLIYYASNRQTGVPSRFSGSGSGTDFTFTISSLQPEDIATYFCQHHYSSPLTFGGGTKLEIK

SEQ ID NO: 972 - protein, 107 aa, synthetic construct
  REGION 1..107: note = >HuVL3_H90S93_Y55R
SIQMTQSPSSLSASVGDRVTITCQASQSVRYNVAWYQQKPGKAPKLLIYYASNRRTGVPSRFSGSGSGTDFTFTISSLQPEDIATYFCQHHYSSPLTFGGGTKLEIK

SEQ ID NO: 973 - protein, 107 aa, synthetic construct
  REGION 1..107: note = >HuVL3_H90S93_Y55V
SIQMTQSPSSLSASVGDRVTITCQASQSVRYNVAWYQQKPGKAPKLLIYYASNRVTGVPSRFSGSGSGTDFTFTISSLQPEDIATYFCQHHYSSPLTFGGGTKLEIK

SEQ ID NO: 974 - protein, 107 aa, synthetic construct
  REGION 1..107: note = >HuVL3_H90S93_Y55W
SIQMTQSPSSLSASVGDRVTITCQASQSVRYNVAWYQQKPGKAPKLLIYYASNRWTGVPSRFSGSGSGTDFTFTISSLQPEDIATYFCQHHYSSPLTFGGGTKLEIK

SEQ ID NO: 975 - protein, 107 aa, synthetic construct; identical to SEQ ID NO: 38
  REGION 1..107: note = >HuVL3_H90S93_T56D

SEQ ID NO: 976 - protein, 107 aa, synthetic construct; identical to SEQ ID NO: 99
  REGION 1..107: note = >HuVL3_H90S93_T56E

SEQ ID NO: 977 - protein, 107 aa, synthetic construct
  REGION 1..107: note = >HuVL3_H90S93_T56F
SIQMTQSPSSLSASVGDRVTITCQASQSVRYNVAWYQQKPGKAPKLLIYYASNRYFGVPSRFSGSGSGTDFTFTISSLQPEDIATYFCQHHYSSPLTFGGGTKLEIK

SEQ ID NO: 978 - protein, 107 aa, synthetic construct
  REGION 1..107: note = >HuVL3_H90S93_T56G
SIQMTQSPSSLSASVGDRVTITCQASQSVRYNVAWYQQKPGKAPKLLIYYASNRYGGVPSRFSGSGSGTDFTFTISSLQPEDIATYFCQHHYSSPLTFGGGTKLEIK

SEQ ID NO: 979 - protein, 107 aa, synthetic construct
  REGION 1..107: note = >HuVL3_H90S93_T56H
SIQMTQSPSSLSASVGDRVTITCQASQSVRYNVAWYQQKPGKAPKLLIYYASNRYHGVPSRFSGSGSGTDFTFTISSLQPEDIATYFCQHHYSSPLTFGGGTKLEIK

SEQ ID NO: 980 - protein, 107 aa, synthetic construct
  REGION 1..107: note = >HuVL3_H90S93_T56L
SIQMTQSPSSLSASVGDRVTITCQASQSVRYNVAWYQQKPGKAPKLLIYYASNRYLGVPSRFSGSGSGTDFTFTISSLQPEDIATYFCQHHYSSPLTFGGGTKLEIK

SEQ ID NO: 981 - protein, 107 aa, synthetic construct
  REGION 1..107: note = >HuVL3_H90S93_T56P
SIQMTQSPSSLSASVGDRVTITCQASQSVRYNVAWYQQKPGKAPKLLIYYASNRYPGVPSRFSGSGSGTDFTFTISSLQPEDIATYFCQHHYSSPLTFGGGTKLEIK

SEQ ID NO: 982 - protein, 107 aa, synthetic construct
  REGION 1..107: note = >HuVL3_H90S93_T56Q
SIQMTQSPSSLSASVGDRVTITCQASQSVRYNVAWYQQKPGKAPKLLIYYASNRYQGVPSRFSGSGSGTDFTFTISSLQPEDIATYFCQHHYSSPLTFGGGTKLEIK

SEQ ID NO: 983 - protein, 107 aa, synthetic construct
  REGION 1..107: note = >HuVL3_H90S93_T56S
SIQMTQSPSSLSASVGDRVTITCQASQSVRYNVAWYQQKPGKAPKLLIYYASNRYSGVPSRFSGSGSGTDFTFTISSLQPEDIATYFCQHHYSSPLTFGGGTKLEIK

SEQ ID NO: 984 - protein, 107 aa, synthetic construct
  REGION 1..107: note = >HuVL3_H90S93_T56V
SIQMTQSPSSLSASVGDRVTITCQASQSVRYNVAWYQQKPGKAPKLLIYYASNRYVGVPSRFSGSGSGTDFTFTISSLQPEDIATYFCQHHYSSPLTFGGGTKLEIK

SEQ ID NO: 985 - protein, 107 aa, synthetic construct
  REGION 1..107: note = >HuVL3_H90S93_T56W
SIQMTQSPSSLSASVGDRVTITCQASQSVRYNVAWYQQKPGKAPKLLIYYASNRYWGVPSRFSGSGSGTDFTFTISSLQPEDIATYFCQHHYSSPLTFGGGTKLEIK

SEQ ID NO: 986 - protein, 107 aa, synthetic construct
  REGION 1..107: note = >HuVL3_H90S93_T56Y
SIQMTQSPSSLSASVGDRVTITCQASQSVRYNVAWYQQKPGKAPKLLIYYASNRYYGVPSRFSGSGSGTDFTFTISSLQPEDIATYFCQHHYSSPLTFGGGTKLEIK

SEQ ID NO: 987 - protein, 107 aa, synthetic construct
  REGION 1..107: note = >TGEXLC_Human_Kappa_204B4_(LPAR1)
DIVLTQSPATLSVTPGDSVSLSCRASQSISNNLHWYQQKSHESPKLLIKYVSQSISGIPSRFSGSGSGTDFTLSINSVETEDFGMYFCQQSNSWPLTFGAGTKLELK

SEQ ID NO: 988 - protein, 110 aa, synthetic construct
  REGION 1..110: note = >187D6_VL
QAVVTQESLLTTSPGETVTLTCRSSTGTISTLNYVNWVQEKPDHLFTGLIHDTNIRAPGVPARFSGSLIGDKAALTITGAQTEDEAIYFCALWYTNHWVFGGGTKLTVLG

SEQ ID NO: 989 - protein, 128 aa, synthetic construct
  REGION 1..128: note = >Tgex_huVH4_Q61A75CDRH343__sil_(LALA_P331S)
AHSQVQLVQSGSELKKPGASVKVSCKASGYTFTSSGISWVRQAPGQGLEWMGEILPRSGYTNYNQGFTGRFVFSADKSASTAYLQISSLKAEDTAVYYCARDKGPSRYTMDYWGQGTTVTVSSASTKG

SEQ ID NO: 990 - protein, 128 aa, synthetic construct
  REGION 1..128: note = >Tgex_huVH4_Q61H96P97P98T99T100b__sil_(LALA_P331S)
AHSQVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHPPTRYTMDYWGQGTTVTVSSASTKG

SEQ ID NO: 991 - protein, 128 aa, synthetic construct
  REGION 1..128: note = >Tgex_huVH4_Q61H96P98T100b__sil_(LALA_P331S)
AHSQVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHGPSRYTMDYWGQGTTVTVSSASTKG

SEQ ID NO: 992 - protein, 128 aa, synthetic construct
  REGION 1..128: note = >Tgex_huVH4_Q61K96P97P98T99T100b__sil_(LALA_P331S)
AHSQVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKPPTRYTMDYWGQGTTVTVSSASTKG

SEQ ID NO: 993 - protein, 128 aa, synthetic construct
  REGION 1..128: note = >Tgex_huVH4_Q61K96P97T99__sil_(LALA_P331S)
AHSQVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKPSTRYAMDYWGQGTTVTVSSASTKG

SEQ ID NO: 994 - protein, 128 aa, synthetic construct
  REGION 1..128: note = >Tgex_huVH4_Q61S75CDRH343__sil_(LALA_P331S)
AHSQVQLVQSGSELKKPGASVKVSCKASGYTFTSSGISWVRQAPGQGLEWMGEILPRSGYTNYNQGFTGRFVFSADKSSSTAYLQISSLKAEDTAVYYCARDKGPSRYTMDYWGQGTTVTVSSASTKG

SEQ ID NO: 995 - protein, 112 aa, synthetic construct
  REGION 1..112: note = >189E7_VL
NIMMTQSPSSLAVSAGEKVTMTCKSSQSVLYSSNQINYLAWYQQKAGQSPKLLIYWASTRESGVPDRFTGSGSGTDFTLTISSVQAEDMAVYYCHQYLSSWTFGGGTKLEIK

SEQ ID NO: 996 - protein, 119 aa, synthetic construct
  REGION 1..119: note = >186A3_VH
EVQLVESGGGLVKPGGSLKLSCAASGFTFSSYAMSWVRQSPEKRLEWVAEISSGGSSSYYPDTVTGRFIISRDNAKNTLYLEMSSLRSEDTAMYYCARDSGSSYGFAYWGQGTLVTVSA

SEQ ID NO: 997 - protein, 128 aa, synthetic construct
  REGION 1..128: note = >187D6_VH
QVQLQQSGPGLVKPSQTLSLTCAISGDSVSNNRAAWNWIRQSPSRGLEWLGRTHYRSKWFNDSAASVKSRITINPDTSKNQFSLHLNSVTPEDAAVYYCARGPGTTESGDFYFGLDVWGQGTTVTVSS

SEQ ID NO: 998 - protein, 120 aa, synthetic construct
  REGION 1..120: note = >189A11mGF_VH
QVQLQQSGAELARPGASVKLSCKASGYTFTSSGISWVKQRTGQGLEWIGEIYPRSAYTNYNGKFKGKATLTADKSSSTAYMELRSLTSEDSAVYFCARDYGSSRYALDYWGQGTSVTVSS

SEQ ID NO: 999 - protein, 119 aa, synthetic construct
  REGION 1..119: note = >189E7_VH
QVQLQQSGAELVRPGSSVKLSCKASGYTFTSYWMDWVKQRPGQGLEWIGHIYPSDSETHYNQKFKDKATLTVDKSSSTAYMQLSSLTSDDSAVYYCARNYGSSLPFDYWGQGTTLTVSS

SEQ ID NO: 1000 - protein, 120 aa, synthetic construct
  REGION 1..120: note = >207B7HuVH4_H97K98S99
QVQLVQSGSELKKPGASVKVSCKASGYTFTSSGISWVRQAPGQGLEWMGEILPRSGYTNYNEGFTGRFVFSADKSVSTAYLQISSLKAEDTAVYYCARDFHKSRYAMDYWGQGTTVTVSS

SEQ ID NO: 1001 - protein, 120 aa, synthetic construct
  REGION 1..120: note = >207B7HuVH4_Q61G97K98G99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGKGRYAMDYWGQGTTVTVSS

SEQ ID NO: 1002 - protein, 120 aa, synthetic construct
  REGION 1..120: note = >207B7HuVH4_Q61G97K98S99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFGKSRYAMDYWGQGTTVTVSS

SEQ ID NO: 1003 - protein, 120 aa, synthetic construct
  REGION 1..120: note = >207B7HuVH4_Q61H97K98G99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFHKGRYAMDYWGQGTTVTVSS

SEQ ID NO: 1004 - protein, 120 aa, synthetic construct
  REGION 1..120: note = >207B7HuVH4_Q61H97K98S99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFHKSRYAMDYWGQGTTVTVSS

SEQ ID NO: 1005 - protein, 120 aa, synthetic construct
  REGION 1..120: note = >207B7HuVH4_Q61H97S98G99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFHSGRYAMDYWGQGTTVTVSS

SEQ ID NO: 1006 - protein, 120 aa, synthetic construct
  REGION 1..120: note = >207B7HuVH4_Q61H97S98S99
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFHSSRYAMDYWGQGTTVTVSS

SEQ ID NO: 1007 - protein, 120 aa, synthetic construct
  REGION 1..120: note = >207B7_S100G_VH
QVQLQQSGAELARPGASVKLSCKASGYTFTSSGISWVKQRTGQGLEWIGEILPRSGYTNYNEKFKGKASLTADKSSSTAYMELRSLTSEDSAVYFCARDFGSSRYAMDYWGQGTSVTVSS

SEQ ID NO: 1008 - protein, 120 aa, synthetic construct
  REGION 1..120: note = >207B7_mGF_E61A_VH
QVQLQQSGAELARPGASVKLSCKASGYTFTSSGISWVKQRTGQGLEWIGEILPRSGYTNYNAKFKGKATLTADKSSSTAYMELRSLTSEDSAVYFCARDFGSSRYAMDYWGQGTSVTVSS

SEQ ID NO: 1009 - protein, 120 aa, synthetic construct
  REGION 1..120: note = >207B7_mGF_F96A_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDAGSSRYAMDYWGQGTSVTVSS

SEQ ID NO: 1010 - protein, 120 aa, synthetic construct
  REGION 1..120: note = >207B7_mGF_G55A_VH
QVQLQQSGAELARPGASVKLSCKASGYTFTSSGISWVKQRTGQGLEWIGEILPRSAYTNYNEKFKGKATLTADKSSSTAYMELRSLTSEDSAVYFCARDFGSSRYAMDYWGQGTSVTVSS

SEQ ID NO: 1011 - protein, 120 aa, synthetic construct
  REGION 1..120: note = >207B7_mGF_G97A_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFASSRYAMDYWGQGTSVTVSS

SEQ ID NO: 1012 - protein, 120 aa, synthetic construct
  REGION 1..120: note = >207B7_mGF_L52A_VH
QVQLQQSGAELARPGASVKLSCKASGYTFTSSGISWVKQRTGQGLEWIGEIAPRSGYTNYNEKFKGKATLTADKSSSTAYMELRSLTSEDSAVYFCARDFGSSRYAMDYWGQGTSVTVSS

SEQ ID NO: 1013 - protein, 120 aa, synthetic construct
  REGION 1..120: note = >207B7_mGF_N58A_VH
QVQLQQSGAELARPGASVKLSCKASGYTFTSSGISWVKQRTGQGLEWIGEILPRSGYTAYNEKFKGKATLTADKSSSTAYMELRSLTSEDSAVYFCARDFGSSRYAMDYWGQGTSVTVSS

SEQ ID NO: 1014 - protein, 120 aa, synthetic construct
  REGION 1..120: note = >207B7_mGF_N60A_VH
QVQLQQSGAELARPGASVKLSCKASGYTFTSSGISWVKQRTGQGLEWIGEILPRSGYTNYAEKFKGKATLTADKSSSTAYMELRSLTSEDSAVYFCARDFGSSRYAMDYWGQGTSVTVSS

SEQ ID NO: 1015 - protein, 120 aa, synthetic construct
  REGION 1..120: note = >207B7_mGF_P52AA_VH
QVQLQQSGAELARPGASVKLSCKASGYTFTSSGISWVKQRTGQGLEWIGEILARSGYTNYNEKFKGKATLTADKSSSTAYMELRSLTSEDSAVYFCARDFGSSRYAMDYWGQGTSVTVSS

SEQ ID NO: 1016 - protein, 120 aa, synthetic construct
  REGION 1..120: note = >207B7_mGF_R53A_VH
QVQLQQSGAELARPGASVKLSCKASGYTFTSSGISWVKQRTGQGLEWIGEILPASGYTNYNEKFKGKATLTADKSSSTAYMELRSLTSEDSAVYFCARDFGSSRYAMDYWGQGTSVTVSS

SEQ ID NO: 1017 - protein, 120 aa, synthetic construct
  REGION 1..120: note = >207B7_mGF_S54A_VH
QVQLQQSGAELARPGASVKLSCKASGYTFTSSGISWVKQRTGQGLEWIGEILPRAGYTNYNEKFKGKATLTADKSSSTAYMELRSLTSEDSAVYFCARDFGSSRYAMDYWGQGTSVTVSS

SEQ ID NO: 1018 - protein, 120 aa, synthetic construct
  REGION 1..120: note = >207B7_mGF_S98A_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGASRYAMDYWGQGTSVTVSS

SEQ ID NO: 1019 - protein, 120 aa, synthetic construct
  REGION 1..120: note = >207B7_mGF_S99A_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGSARYAMDYWGQGTSVTVSS

SEQ ID NO: 1020 - protein, 120 aa, synthetic construct
  REGION 1..120: note = >207B7_mGF_T57A_VH
QVQLQQSGAELARPGASVKLSCKASGYTFTSSGISWVKQRTGQGLEWIGEILPRSGYANYNEKFKGKATLTADKSSSTAYMELRSLTSEDSAVYFCARDFGSSRYAMDYWGQGTSVTVSS

SEQ ID NO: 1021 - protein, 120 aa, synthetic construct
  REGION 1..120: note = >207B7_mGF_Y100AA_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGSSRAAMDYWGQGTSVTVSS

SEQ ID NO: 1022 - protein, 120 aa, synthetic construct
  REGION 1..120: note = >207B7_mGF_Y56A_VH
QVQLQQSGAELARPGASVKLSCKASGYTFTSSGISWVKQRTGQGLEWIGEILPRSGATNYNEKFKGKATLTADKSSSTAYMELRSLTSEDSAVYFCARDFGSSRYAMDYWGQGTSVTVSS

SEQ ID NO: 1023 - protein, 120 aa, synthetic construct
  REGION 1..120: note = >207B7mGF_D86E_VH
QVQLQQSGAELARPGASVKLSCKASGYTFTSSGISWVKQRTGQGLEWIGEILPRSGYTNYNEKFKGKATLTADKSSSTAYMELRSLTSEESAVYFCARDFGSSRYAMDYWGQGTSVTVSS

SEQ ID NO: 1024 - protein, 120 aa, synthetic construct
  REGION 1..120: note = >207B7mGF_GLCDRH1_VH
QVQLQQSGAELARPGASVKLSCKASGYTFTSYGISWVKQRTGQGLEWIGEILPRSGYTNYNEKFKGKATLTADKSSSTAYMELRSLTSEDSAVYFCARDFGSSRYAMDYWGQGTSVTVSS

SEQ ID NO: 1025 - protein, 120 aa, synthetic construct
  REGION 1..120: note = >207B7mGF_GLCDRH3_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDYGSSRYAMDYWGQGTSVTVSS

SEQ ID NO: 1026 - protein, 120 aa, synthetic construct
  REGION 1..120: note = >207B7mGF_I34M_VH
QVQLQQSGAELARPGASVKLSCKASGYTFTSSGMSWVKQRTGQGLEWIGEILPRSGYTNYNEKFKGKATLTADKSSSTAYMELRSLTSEDSAVYFCARDFGSSRYAMDYWGQGTSVTVSS

SEQ ID NO: 1027 - protein, 120 aa, synthetic construct
  REGION 1..120: note = >207B7mGF_L52Y_VH
QVQLQQSGAELARPGASVKLSCKASGYTFTSSGISWVKQRTGQGLEWIGEIYPRSGYTNYNEKFKGKATLTADKSSSTAYMELRSLTSEDSAVYFCARDFGSSRYAMDYWGQGTSVTVSS

SEQ ID NO: 1028 - protein, 120 aa, synthetic construct
  REGION 1..120: note = >207B7mGF_N58Y_VH
QVQLQQSGAELARPGASVKLSCKASGYTFTSSGISWVKQRTGQGLEWIGEILPRSGYTYYNEKFKGKATLTADKSSSTAYMELRSLTSEDSAVYFCARDFGSSRYAMDYWGQGTSVTVSS

SEQ ID NO: 1029 - protein, 120 aa, synthetic construct
  REGION 1..120: note = >207B7mGF_YTNNTY_VH
QVQLQQSGAELARPGASVKLSCKASGYTFTSSGISWVKQRTGQGLEWIGEILPRSGNTYYNEKFKGKATLTADKSSSTAYMELRSLTSEDSAVYFCARDFGSSRYAMDYWGQGTSVTVSS

SEQ ID NO: 1030 - protein, 120 aa, synthetic construct
  REGION 1..120: note = >207mGF_189CDRmuts_VH
QVQLQQSGAELARPGASVKLSCKASGYTFTSSGISWVKQRTGQGLEWIGEILPRSAYTNYNGKFKGKATLTADKSSSTAYMELRSLTSEDSAVYFCARDFGSSRYALDYWGQGTSVTVSS

SEQ ID NO: 1031 - protein, 120 aa, synthetic construct
  REGION 1..120: note = >207mGF_E61G_VH
QVQLQQSGAELARPGASVKLSCKASGYTFTSSGISWVKQRTGQGLEWIGEILPRSGYTNYNGKFKGKATLTADKSSSTAYMELRSLTSEDSAVYFCARDFGSSRYAMDYWGQGTSVTVSS

SEQ ID NO: 1032 - protein, 120 aa, synthetic construct
  REGION 1..120: note = >207mGF_G55A_E61G_VH
QVQLQQSGAELARPGASVKLSCKASGYTFTSSGISWVKQRTGQGLEWIGEILPRSAYTNYNGKFKGKATLTADKSSSTAYMELRSLTSEDSAVYFCARDFGSSRYAMDYWGQGTSVTVSS

SEQ ID NO: 1033 - protein, 120 aa, synthetic construct; identical to SEQ ID NO: 1010
  REGION 1..120: note = >207mGF_G55A_VH

SEQ ID NO: 1034 - protein, 120 aa, synthetic construct
  REGION 1..120: note = >207mGF_G97D_S98N_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFDNSRYAMDYWGQGTSVTVSS

SEQ ID NO: 1035 - protein, 120 aa, synthetic construct
  REGION 1..120: note = >207mGF_G97D_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFDSSRYAMDYWGQGTSVTVSS

SEQ ID NO: 1036 - protein, 120 aa, synthetic construct
  REGION 1..120: note = >207mGF_M100L_E61G_VH
QVQLQQSGAELARPGASVKLSCKASGYTFTSSGISWVKQRTGQGLEWIGEILPRSGYTNYNGKFKGKATLTADKSSSTAYMELRSLTSEDSAVYFCARDFGSSRYALDYWGQGTSVTVSS

SEQ ID NO: 1037 - protein, 120 aa, synthetic construct
  REGION 1..120: note = >207mGF_M100L_G55A_VH
QVQLQQSGAELARPGASVKLSCKASGYTFTSSGISWVKQRTGQGLEWIGEILPRSAYTNYNEKFKGKATLTADKSSSTAYMELRSLTSEDSAVYFCARDFGSSRYALDYWGQGTSVTVSS

SEQ ID NO: 1038 - protein, 120 aa, synthetic construct
  REGION 1..120: note = >207mGF_M100L_G97D_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFDSSRYALDYWGQGTSVTVSS

SEQ ID NO: 1039 - protein, 120 aa, synthetic construct
  REGION 1..120: note = >207mGF_M100L_S98N_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGNSRYALDYWGQGTSVTVSS

SEQ ID NO: 1040 - protein, 120 aa, synthetic construct
  REGION 1..120: note = >207mGF_M100L_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGSSRYALDYWGQGTSVTVSS

SEQ ID NO: 1041 - protein, 120 aa, synthetic construct
  REGION 1..120: note = >207mGF_S98N_VH
QVQLQQSGAELARPGASVKLSCKASGYTFTSSGISWVKQRTGQGLEWIGEILPRSGYTNYNEKFKGKATLTADKSSSTAYMELRSLTSEDSAVYFCARDFGNSRYAMDYWGQGTSVTVSS

SEQ ID NO: 1042 - protein, 120 aa, synthetic construct
  REGION 1..120: note = >31D8_VH
EVQLVESGGGLVKPGGSLKLSCAASGFTFSSYVMSWVRQSPEKRLEWVAEINSGGSYTNYPDTVTGRFTISRDNSKNTLYLEMSSLRSEDTAMYYCTRDRYGSRYTMDYWGQGTSVTVSS

SEQ ID NO: 1043 - protein, 119 aa, synthetic construct
  REGION 1..119: note = >62A4_VH
QVQLQQPGTELVKPGASVKLSCKASGYTFTSYWMHWMKQRPGQGLEWIGEINPINGRTYYNEKFKRKATLTVDKSSSTAYMQLSSLPSEDSAVYYCARRDRIMVYFDYWGQGTSLTVSS

SEQ ID NO: 1044 - protein, 120 aa, synthetic construct
  REGION 1..120: note = >AA_207B7_huVH1_VH
QVQLVQSGAEVKKPGASVKVSCKASGYTFTSSGISWVRQAPGQGLEWIGEILPRSGYTNYNEKLQGRVTLTADKSSSTAYMELRSLRSDDTAVYFCARDFGSSRYAMDYWGQGTTVTVSS

SEQ ID NO: 1045 - protein, 120 aa, synthetic construct; identical to SEQ ID NO: 96
  REGION 1..120: note = >AA_207B7_huVH3_VH

SEQ ID NO: 1046 - protein, 120 aa, synthetic construct; identical to SEQ ID NO: 33
  REGION 1..120: note = >AA_207B7_huVH4_VH

SEQ ID NO: 1047 - protein, 120 aa, synthetic construct
  REGION 1..120: note = >TGEXHC_Human_IgG1_189A11
QVQLQQSGAELARPGASVKLSCKASGYTFTSSGISWVKQRTGQGLEWIGEIYPRSAYTNYNGKFKGKASLTADKSSRTAYMELRSLTSEDSAVYFCARDYGSSRYALDYWGQGTSVTVSS

SEQ ID NO: 1048 - protein, 120 aa, synthetic construct
  REGION 1..120: note = >TGEXHC_Human_IgG1_189B8
QVQLQQSGAELARPGASVKLSCKASGYTFTSSGISWVKQRTGQGLEWIGEIYPRSGYTYCNEKFKGKASLTADKSSSTAYMELRSLTSEDSAVYFCARDYGSSRYAMDYWGQGTSVTVSS

SEQ ID NO: 1049 - protein, 120 aa, synthetic construct
  REGION 1..120: note = >TGEXHC_Human_IgG1_192E9
QVHLQQSGAELARPGASVKLSCKGSGYTFTSNGISWVKQRAGQGLEWIGEIYPRSGNTYYNEKFKGKATLTADKSSSTAYMELRSLTSEDSAVYFCARDGSKYRYAMDYWGQGTSVTVPS

SEQ ID NO: 1050 - protein, 118 aa, synthetic construct
  REGION 1..118: note = >TGEXHC_Human_IgG1_92C5/92D12_primary
QVQLQQSGAELVKPGASVKLSCKASGYTFTSYYMYWVKQRPGQGLEWIGEINPGNGVTNFNEKFKTKAALTVDKSSTTAYIQFNSLTSEDSAVYYCARGGRERLFDYWGHGTTLRVSS

SEQ ID NO: 1051 - protein, 118 aa, synthetic construct
  REGION 1..118: note = >TGEXHC_silenced_Human_IgG1_140D6_(LPAR1)
QVQLQQPGAELVKPGASVKLSCKASAYTFTSYWMHWVKQRPGRGLEWIGRVDPDSGGPNYNEKFKNKATLTVDKPSSTAYMQLSSLTSEDSAVYYCSRGGREGLFDYWGQGTTLTVSS

SEQ ID NO: 1052 - protein, 112 aa, synthetic construct
  REGION 1..112: note = >TGEXHC_silenced_Human_IgG1_204B4_(LPAR1)
QVQLKESGPGLVAPSQSLSITCTVSGFSLTSYGVDWVRQSPGKGLEWLGVIWGVGRTNYNSALKSRLSISKDNSKSQVFLKMNSLQTDDTAMYYCARSLAYWGQGTLVTVSA

SEQ ID NO: 1053 - protein, 120 aa, synthetic construct
  REGION 1..120: note = >huVH4_Q61R97G99G104_Fab_F96A
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDARSGRYAMDYWGQGTTVTVSS

SEQ ID NO: 1054 - protein, 120 aa, synthetic construct
  REGION 1..120: note = >huVH4_Q61R97G99G104_Fab_F96D
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDDRSGRYAMDYWGQGTTVTVSS

SEQ ID NO: 1055 - protein, 120 aa, synthetic construct
  REGION 1..120: note = >huVH4_Q61R97G99G104_Fab_F96E
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDERSGRYAMDYWGQGTTVTVSS

SEQ ID NO: 1056 - protein, 120 aa, synthetic construct
  REGION 1..120: note = >huVH4_Q61R97G99G104_Fab_F96G
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDGRSGRYAMDYWGQGTTVTVSS

SEQ ID NO: 1057 - protein, 120 aa, synthetic construct
  REGION 1..120: note = >huVH4_Q61R97G99G104_Fab_F96H
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDHRSGRYAMDYWGQGTTVTVSS

SEQ ID NO: 1058 - protein, 120 aa, synthetic construct
  REGION 1..120: note = >huVH4_Q61R97G99G104_Fab_F96I
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDIRSGRYAMDYWGQGTTVTVSS

SEQ ID NO: 1059 - protein, 120 aa, synthetic construct
  REGION 1..120: note = >huVH4_Q61R97G99G104_Fab_F96K
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDKRSGRYAMDYWGQGTTVTVSS

SEQ ID NO: 1060 - protein, 120 aa, synthetic construct
  REGION 1..120: note = >huVH4_Q61R97G99G104_Fab_F96L
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDLRSGRYAMDYWGQGTTVTVSS

SEQ ID NO: 1061 - protein, 120 aa, synthetic construct
  REGION 1..120: note = >huVH4_Q61R97G99G104_Fab_F96M
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDMRSGRYAMDYWGQGTTVTVSS

SEQ ID NO: 1062 - protein, 120 aa, synthetic construct
  REGION 1..120: note = >huVH4_Q61R97G99G104_Fab_F96N
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDNRSGRYAMDYWGQGTTVTVSS

SEQ ID NO: 1063 - protein, 120 aa, synthetic construct
  REGION 1..120: note = >huVH4_Q61R97G99G104_Fab_F96P
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDPRSGRYAMDYWGQGTTVTVSS

SEQ ID NO: 1064 - protein, 120 aa, synthetic construct
  REGION 1..120: note = >huVH4_Q61R97G99G104_Fab_F96Q
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDQRSGRYAMDYWGQGTTVTVSS

SEQ ID NO: 1065 - protein, 120 aa, synthetic construct
  REGION 1..120: note = >huVH4_Q61R97G99G104_Fab_F96R
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDRRSGRYAMDYWGQGTTVTVSS

SEQ ID NO: 1066 - protein, 120 aa, synthetic construct
  REGION 1..120: note = >huVH4_Q61R97G99G104_Fab_F96S
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDSRSGRYAMDYWGQGTTVTVSS

SEQ ID NO: 1067 - protein, 120 aa, synthetic construct
  REGION 1..120: note = >huVH4_Q61R97G99G104_Fab_F96T
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDTRSGRYAMDYWGQGTTVTVSS

SEQ ID NO: 1068 - protein, 120 aa, synthetic construct
  REGION 1..120: note = >huVH4_Q61R97G99G104_Fab_F96V
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDVRSGRYAMDYWGQGTTVTVSS

SEQ ID NO: 1069 - protein, 120 aa, synthetic construct
  REGION 1..120: note = >huVH4_Q61R97G99G104_Fab_F96W
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDWRSGRYAMDYWGQGTTVTVSS

SEQ ID NO: 1070 - protein, 120 aa, synthetic construct
  REGION 1..120: note = >huVH4_Q61R97G99G104_Fab_F96Y
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDYRSGRYAMDYWGQGTTVTVSS

SEQ ID NO: 1071 - protein, 120 aa, synthetic construct
  REGION 1..120: note = >huVH4_Q61R97G99G104_Fab_G62A
QVQLVQSGSELKKPGASVKVSCKASGYTFTSSGISWVRQAPGQGLEWMGEILPRSGYTNYNQAFTGRFVFSADKSVSTAYLQISSLKAEDTAVYYCARDFRSGRYAMDYWGQGTTVTVSS

SEQ ID NO: 1072 - protein, 120 aa, synthetic construct
  REGION 1..120: note = >huVH4_Q61R97G99G104_Fab_G62D
QVQLVQSGSELKKPGASVKVSCKASGYTFTSSGISWVRQAPGQGLEWMGEILPRSGYTNYNQDFTGRFVFSADKSVSTAYLQISSLKAEDTAVYYCARDFRSGRYAMDYWGQGTTVTVSS

SEQ ID NO: 1073 - protein, 120 aa, synthetic construct
  REGION 1..120: note = >huVH4_Q61R97G99G104_Fab_G62E
QVQLVQSGSELKKPGASVKVSCKASGYTFTSSGISWVRQAPGQGLEWMGEILPRSGYTNYNQEFTGRFVFSADKSVSTAYLQISSLKAEDTAVYYCARDFRSGRYAMDYWGQGTTVTVSS

SEQ ID NO: 1074 - protein, 120 aa, synthetic construct
  REGION 1..120: note = >huVH4_Q61R97G99G104_Fab_G62F
QVQLVQSGSELKKPGASVKVSCKASGYTFTSSGISWVRQAPGQGLEWMGEILPRSGYTNYNQFFTGRFVFSADKSVSTAYLQISSLKAEDTAVYYCARDFRSGRYAMDYWGQGTTVTVSS

SEQ ID NO: 1075 - protein, 120 aa, synthetic construct
  REGION 1..120: note = >huVH4_Q61R97G99G104_Fab_G62H
QVQLVQSGSELKKPGASVKVSCKASGYTFTSSGISWVRQAPGQGLEWMGEILPRSGYTNYNQHFTGRFVFSADKSVSTAYLQISSLKAEDTAVYYCARDFRSGRYAMDYWGQGTTVTVSS

SEQ ID NO: 1076 - protein, 120 aa, synthetic construct
  REGION 1..120: note = >huVH4_Q61R97G99G104_Fab_G62I
QVQLVQSGSELKKPGASVKVSCKASGYTFTSSGISWVRQAPGQGLEWMGEILPRSGYTNYNQIFTGRFVFSADKSVSTAYLQISSLKAEDTAVYYCARDFRSGRYAMDYWGQGTTVTVSS

SEQ ID NO: 1077 - protein, 120 aa, synthetic construct
  REGION 1..120: note = >huVH4_Q61R97G99G104_Fab_G62K
QVQLVQSGSELKKPGASVKVSCKASGYTFTSSGISWVRQAPGQGLEWMGEILPRSGYTNYNQKFTGRFVFSADKSVSTAYLQISSLKAEDTAVYYCARDFRSGRYAMDYWGQGTTVTVSS

SEQ ID NO: 1078 - protein, 120 aa, synthetic construct
  REGION 1..120: note = >huVH4_Q61R97G99G104_Fab_G62L
QVQLVQSGSELKKPGASVKVSCKASGYTFTSSGISWVRQAPGQGLEWMGEILPRSGYTNYNQLFTGRFVFSADKSVSTAYLQISSLKAEDTAVYYCARDFRSGRYAMDYWGQGTTVTVSS

SEQ ID NO: 1079 - protein, 120 aa, synthetic construct
  REGION 1..120: note = >huVH4_Q61R97G99G104_Fab_G62M
QVQLVQSGSELKKPGASVKVSCKASGYTFTSSGISWVRQAPGQGLEWMGEILPRSGYTNYNQMFTGRFVFSADKSVSTAYLQISSLKAEDTAVYYCARDFRSGRYAMDYWGQGTTVTVSS

SEQ ID NO: 1080 - protein, 120 aa, synthetic construct
  REGION 1..120: note = >huVH4_Q61R97G99G104_Fab_G62N
QVQLVQSGSELKKPGASVKVSCKASGYTFTSSGISWVRQAPGQGLEWMGEILPRSGYTNYNQNFTGRFVFSADKSVSTAYLQISSLKAEDTAVYYCARDFRSGRYAMDYWGQGTTVTVSS

SEQ ID NO: 1081 - protein, 120 aa, synthetic construct
  REGION 1..120: note = >huVH4_Q61R97G99G104_Fab_G62P
QVQLVQSGSELKKPGASVKVSCKASGYTFTSSGISWVRQAPGQGLEWMGEILPRSGYTNYNQPFTGRFVFSADKSVSTAYLQISSLKAEDTAVYYCARDFRSGRYAMDYWGQGTTVTVSS

SEQ ID NO: 1082 - protein, 120 aa, synthetic construct
  REGION 1..120: note = >huVH4_Q61R97G99G104_Fab_G62Q
QVQLVQSGSELKKPGASVKVSCKASGYTFTSSGISWVRQAPGQGLEWMGEILPRSGYTNYNQQFTGRFVFSADKSVSTAYLQISSLKAEDTAVYYCARDFRSGRYAMDYWGQGTTVTVSS

SEQ ID NO: 1083 - protein, 120 aa, synthetic construct
  REGION 1..120: note = >huVH4_Q61R97G99G104_Fab_G62R
QVQLVQSGSELKKPGASVKVSCKASGYTFTSSGISWVRQAPGQGLEWMGEILPRSGYTNYNQRFTGRFVFSADKSVSTAYLQISSLKAEDTAVYYCARDFRSGRYAMDYWGQGTTVTVSS

SEQ ID NO: 1084 - protein, 120 aa, synthetic construct
  REGION 1..120: note = >huVH4_Q61R97G99G104_Fab_G62S
QVQLVQSGSELKKPGASVKVSCKASGYTFTSSGISWVRQAPGQGLEWMGEILPRSGYTNYNQSFTGRFVFSADKSVSTAYLQISSLKAEDTAVYYCARDFRSGRYAMDYWGQGTTVTVSS

SEQ ID NO: 1085 - protein, 120 aa, synthetic construct
  REGION 1..120: note = >huVH4_Q61R97G99G104_Fab_G62T
QVQLVQSGSELKKPGASVKVSCKASGYTFTSSGISWVRQAPGQGLEWMGEILPRSGYTNYNQTFTGRFVFSADKSVSTAYLQISSLKAEDTAVYYCARDFRSGRYAMDYWGQGTTVTVSS

SEQ ID NO: 1086 - protein, 120 aa, synthetic construct
  REGION 1..120: note = >huVH4_Q61R97G99G104_Fab_G62V
QVQLVQSGSELKKPGASVKVSCKASGYTFTSSGISWVRQAPGQGLEWMGEILPRSGYTNYNQVFTGRFVFSADKSVSTAYLQISSLKAEDTAVYYCARDFRSGRYAMDYWGQGTTVTVSS

SEQ ID NO: 1087 - protein, 120 aa, synthetic construct
  REGION 1..120: note = >huVH4_Q61R97G99G104_Fab_G62W
QVQLVQSGSELKKPGASVKVSCKASGYTFTSSGISWVRQAPGQGLEWMGEILPRSGYTNYNQWFTGRFVFSADKSVSTAYLQISSLKAEDTAVYYCARDFRSGRYAMDYWGQGTTVTVSS

SEQ ID NO: 1088 - protein, 120 aa, synthetic construct
  REGION 1..120: note = >huVH4_Q61R97G99G104_Fab_G62Y
QVQLVQSGSELKKPGASVKVSCKASGYTFTSSGISWVRQAPGQGLEWMGEILPRSGYTNYNQYFTGRFVFSADKSVSTAYLQISSLKAEDTAVYYCARDFRSGRYAMDYWGQGTTVTVSS

SEQ ID NO: 1089 - protein, 120 aa, synthetic construct
  REGION 1..120: note = >huVH4_Q61R97G99G104_Fab_N60D
QVQLVQSGSELKKPGASVKVSCKASGYTFTSSGISWVRQAPGQGLEWMGEILPRSGYTNYDQGFTGRFVFSADKSVSTAYLQISSLKAEDTAVYYCARDFRSGRYAMDYWGQGTTVTVSS

SEQ ID NO: 1090 - protein, 120 aa, synthetic construct
  REGION 1..120: note = >huVH4_Q61R97G99G104_Fab_N60E
QVQLVQSGSELKKPGASVKVSCKASGYTFTSSGISWVRQAPGQGLEWMGEILPRSGYTNYEQGFTGRFVFSADKSVSTAYLQISSLKAEDTAVYYCARDFRSGRYAMDYWGQGTTVTVSS

SEQ ID NO: 1091 - protein, 120 aa, synthetic construct
  REGION 1..120: note = >huVH4_Q61R97G99G104_Fab_N60F
QVQLVQSGSELKKPGASVKVSCKASGYTFTSSGISWVRQAPGQGLEWMGEILPRSGYTNYFQGFTGRFVFSADKSVSTAYLQISSLKAEDTAVYYCARDFRSGRYAMDYWGQGTTVTVSS

SEQ ID NO: 1092 - protein, 120 aa, synthetic construct
  REGION 1..120: note = >huVH4_Q61R97G99G104_Fab_N60G
QVQLVQSGSELKKPGASVKVSCKASGYTFTSSGISWVRQAPGQGLEWMGEILPRSGYTNYGQGFTGRFVFSADKSVSTAYLQISSLKAEDTAVYYCARDFRSGRYAMDYWGQGTTVTVSS

SEQ ID NO: 1093 - protein, 120 aa, synthetic construct
  REGION 1..120: note = >huVH4_Q61R97G99G104_Fab_N60H
QVQLVQSGSELKKPGASVKVSCKASGYTFTSSGISWVRQAPGQGLEWMGEILPRSGYTNYHQGFTGRFVFSADKSVSTAYLQISSLKAEDTAVYYCARDFRSGRYAMDYWGQGTTVTVSS

SEQ ID NO: 1094 - protein, 120 aa, synthetic construct
  REGION 1..120: note = >huVH4_Q61R97G99G104_Fab_N60I
QVQLVQSGSELKKPGASVKVSCKASGYTFTSSGISWVRQAPGQGLEWMGEILPRSGYTNYIQGFTGRFVFSADKSVSTAYLQISSLKAEDTAVYYCARDFRSGRYAMDYWGQGTTVTVSS

SEQ ID NO: 1095 - protein, 120 aa, synthetic construct
  REGION 1..120: note = >huVH4_Q61R97G99G104_Fab_N60K
QVQLVQSGSELKKPGASVKVSCKASGYTFTSSGISWVRQAPGQGLEWMGEILPRSGYTNYKQGFTGRFVFSADKSVSTAYLQISSLKAEDTAVYYCARDFRSGRYAMDYWGQGTTVTVSS

SEQ ID NO: 1096 - protein, 120 aa, synthetic construct
  REGION 1..120: note = >huVH4_Q61R97G99G104_Fab_N60L
QVQLVQSGSELKKPGASVKVSCKASGYTFTSSGISWVRQAPGQGLEWMGEILPRSGYTNYLQGFTGRFVFSADKSVSTAYLQISSLKAEDTAVYYCARDFRSGRYAMDYWGQGTTVTVSS

SEQ ID NO: 1097 - protein, 120 aa, synthetic construct
  REGION 1..120: note = >huVH4_Q61R97G99G104_Fab_N60M
QVQLVQSGSELKKPGASVKVSCKASGYTFTSSGISWVRQAPGQGLEWMGEILPRSGYTNYMQGFTGRFVFSADKSVSTAYLQISSLKAEDTAVYYCARDFRSGRYAMDYWGQGTTVTVSS

SEQ ID NO: 1098 - protein, 120 aa, synthetic construct
  REGION 1..120: note = >huVH4_Q61R97G99G104_Fab_N60P
QVQLVQSGSELKKPGASVKVSCKASGYTFTSSGISWVRQAPGQGLEWMGEILPRSGYTNYPQGFTGRFVFSADKSVSTAYLQISSLKAEDTAVYYCARDFRSGRYAMDYWGQGTTVTVSS

SEQ ID NO: 1099 - protein, 120 aa, synthetic construct
  REGION 1..120: note = >huVH4_Q61R97G99G104_Fab_N60Q
QVQLVQSGSELKKPGASVKVSCKASGYTFTSSGISWVRQAPGQGLEWMGEILPRSGYTNYQQGFTGRFVFSADKSVSTAYLQISSLKAEDTAVYYCARDFRSGRYAMDYWGQGTTVTVSS

SEQ ID NO: 1100 - protein, 120 aa, synthetic construct
  REGION 1..120: note = >huVH4_Q61R97G99G104_Fab_N60R
QVQLVQSGSELKKPGASVKVSCKASGYTFTSSGISWVRQAPGQGLEWMGEILPRSGYTNYRQGFTGRFVFSADKSVSTAYLQISSLKAEDTAVYYCARDFRSGRYAMDYWGQGTTVTVSS

SEQ ID NO: 1101 - protein, 120 aa, synthetic construct
  REGION 1..120: note = >huVH4_Q61R97G99G104_Fab_N60S
QVQLVQSGSELKKPGASVKVSCKASGYTFTSSGISWVRQAPGQGLEWMGEILPRSGYTNYSQGFTGRFVFSADKSVSTAYLQISSLKAEDTAVYYCARDFRSGRYAMDYWGQGTTVTVSS

SEQ ID NO: 1102 - protein, 120 aa, synthetic construct
  REGION 1..120: note = >huVH4_Q61R97G99G104_Fab_N60T
QVQLVQSGSELKKPGASVKVSCKASGYTFTSSGISWVRQAPGQGLEWMGEILPRSGYTNYTQGFTGRFVFSADKSVSTAYLQISSLKAEDTAVYYCARDFRSGRYAMDYWGQGTTVTVSS

SEQ ID NO: 1103 - protein, 120 aa, synthetic construct
  REGION 1..120: note = >huVH4_Q61R97G99G104_Fab_N60V
QVQLVQSGSELKKPGASVKVSCKASGYTFTSSGISWVRQAPGQGLEWMGEILPRSGYTNYVQGFTGRFVFSADKSVSTAYLQISSLKAEDTAVYYCARDFRSGRYAMDYWGQGTTVTVSS

SEQ ID NO: 1104 - protein, 120 aa, synthetic construct
  REGION 1..120: note = >huVH4_Q61R97G99G104_Fab_N60W
QVQLVQSGSELKKPGASVKVSCKASGYTFTSSGISWVRQAPGQGLEWMGEILPRSGYTNYWQGFTGRFVFSADKSVSTAYLQISSLKAEDTAVYYCARDFRSGRYAMDYWGQGTTVTVSS

SEQ ID NO: 1105 - protein, 120 aa, synthetic construct
  REGION 1..120: note = >huVH4_Q61R97G99G104_Fab_N60Y
QVQLVQSGSELKKPGASVKVSCKASGYTFTSSGISWVRQAPGQGLEWMGEILPRSGYTNYYQGFTGRFVFSADKSVSTAYLQISSLKAEDTAVYYCARDFRSGRYAMDYWGQGTTVTVSS

SEQ ID NO: 1106 - protein, 120 aa, synthetic construct
  REGION 1..120: note = >huVH4_Q61R97G99G104_Fab_R100A
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGAYAMDYWGQGTTVTVSS

SEQ ID NO: 1107 - protein, 120 aa, synthetic construct
  REGION 1..120: note = >huVH4_Q61R97G99G104_Fab_R100D
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGDYAMDYWGQGTTVTVSS

SEQ ID NO: 1108 - protein, 120 aa, synthetic construct
  REGION 1..120: note = >huVH4_Q61R97G99G104_Fab_R100E
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGEYAMDYWGQGTTVTVSS

SEQ ID NO: 1109 - protein, 120 aa, synthetic construct
  REGION 1..120: note = >huVH4_Q61R97G99G104_Fab_R100F
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGFYAMDYWGQGTTVTVSS

SEQ ID NO: 1110 - protein, 120 aa, synthetic construct
  REGION 1..120: note = >huVH4_Q61R97G99G104_Fab_R100G
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGGYAMDYWGQGTTVTVSS

SEQ ID NO: 1111 - protein, 120 aa, synthetic construct
  REGION 1..120: note = >huVH4_Q61R97G99G104_Fab_R100H
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGHYAMDYWGQGTTVTVSS

SEQ ID NO: 1112 - protein, 120 aa, synthetic construct
  REGION 1..120: note = >huVH4_Q61R97G99G104_Fab_R100I
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGIYAMDYWGQGTTVTVSS

SEQ ID NO: 1113 - protein, 120 aa, synthetic construct
  REGION 1..120: note = >huVH4_Q61R97G99G104_Fab_R100K
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGKYAMDYWGQGTTVTVSS

SEQ ID NO: 1114 - protein, 120 aa, synthetic construct
  REGION 1..120: note = >huVH4_Q61R97G99G104_Fab_R100L
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGLYAMDYWGQGTTVTVSS

SEQ ID NO: 1115 - protein, 120 aa, synthetic construct
  REGION 1..120: note = >huVH4_Q61R97G99G104_Fab_R100M
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGMYAMDYWGQGTTVTVSS

SEQ ID NO: 1116 - protein, 120 aa, synthetic construct
  REGION 1..120: note = Artificial Sequence
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGNYAMDYWGQGTTVTVSS

SEQ ID NO: 1117 - protein, 120 aa, synthetic construct
  REGION 1..120: note = >huVH4_Q61R97G99G104_Fab_R100P
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGPYAMDYWGQGTTVTVSS

SEQ ID NO: 1118 - protein, 120 aa, synthetic construct
  REGION 1..120: note = >huVH4_Q61R97G99G104_Fab_R100Q
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGQYAMDYWGQGTTVTVSS

SEQ ID NO: 1119 - protein, 120 aa, synthetic construct
  REGION 1..120: note = >huVH4_Q61R97G99G104_Fab_R100S
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGSYAMDYWGQGTTVTVSS

SEQ ID NO: 1120 - protein, 120 aa, synthetic construct
  REGION 1..120: note = >huVH4_Q61R97G99G104_Fab_R100T
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGTYAMDYWGQGTTVTVSS

SEQ ID NO: 1121 - protein, 120 aa, synthetic construct
  REGION 1..120: note = >huVH4_Q61R97G99G104_Fab_R100V
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGVYAMDYWGQGTTVTVSS

SEQ ID NO: 1122 - protein, 120 aa, synthetic construct
  REGION 1..120: note = >huVH4_Q61R97G99G104_Fab_R100W
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGWYAMDYWGQGTTVTVSS

SEQ ID NO: 1123 - protein, 120 aa, synthetic construct
  REGION 1..120: note = >huVH4_Q61R97G99G104_Fab_R100Y
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGYYAMDYWGQGTTVTVSS

SEQ ID NO: 1124 - protein, 120 aa, synthetic construct
  REGION 1..120: note = >huVH4_Q61R97G99G104_Fab_S31D
QVQLVQSGSELKKPGASVKVSCKASGYTFTDSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1125 - protein, 120 aa, synthetic construct
  REGION 1..120: note = >huVH4_Q61R97G99G104_Fab_S31E
QVQLVQSGSELKKPGASVKVSCKASGYTFTESGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1126 - protein, 120 aa, synthetic construct
  REGION 1..120: note = >huVH4_Q61R97G99G104_Fab_S31F
QVQLVQSGSELKKPGASVKVSCKASGYTFTFSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1127 - protein, 120 aa, synthetic construct
  REGION 1..120: note = >huVH4_Q61R97G99G104_Fab_S31G
QVQLVQSGSELKKPGASVKVSCKASGYTFTGSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1128 - protein, 120 aa, synthetic construct
  REGION 1..120: note = >huVH4_Q61R97G99G104_Fab_S31H
QVQLVQSGSELKKPGASVKVSCKASGYTFTHSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1129 - protein, 120 aa, synthetic construct
  REGION 1..120: note = >huVH4_Q61R97G99G104_Fab_S31I
QVQLVQSGSELKKPGASVKVSCKASGYTFTISGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1130 - protein, 120 aa, synthetic construct
  REGION 1..120: note = >huVH4_Q61R97G99G104_Fab_S31K
QVQLVQSGSELKKPGASVKVSCKASGYTFTKSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1131 - protein, 120 aa, synthetic construct
  REGION 1..120: note = >huVH4_Q61R97G99G104_Fab_S31L
QVQLVQSGSELKKPGASVKVSCKASGYTFTLSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1132 - protein, 120 aa, synthetic construct
  REGION 1..120: note = >huVH4_Q61R97G99G104_Fab_S31M
QVQLVQSGSELKKPGASVKVSCKASGYTFTMSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1133 - protein, 120 aa, synthetic construct
  REGION 1..120: note = >huVH4_Q61R97G99G104_Fab_S31N
QVQLVQSGSELKKPGASVKVSCKASGYTFTNSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1134 - protein, 120 aa, synthetic construct
  REGION 1..120: note = >huVH4_Q61R97G99G104_Fab_S31P
QVQLVQSGSELKKPGASVKVSCKASGYTFTPSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1135 - protein, 120 aa, synthetic construct
  REGION 1..120: note = >huVH4_Q61R97G99G104_Fab_S31Q
QVQLVQSGSELKKPGASVKVSCKASGYTFTQSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1136 - protein, 120 aa, synthetic construct
  REGION 1..120: note = >huVH4_Q61R97G99G104_Fab_S31R
QVQLVQSGSELKKPGASVKVSCKASGYTFTRSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1137 - protein, 120 aa, synthetic construct
  REGION 1..120: note = >huVH4_Q61R97G99G104_Fab_S31T
QVQLVQSGSELKKPGASVKVSCKASGYTFTTSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1138 - protein, 120 aa, synthetic construct
  REGION 1..120: note = >huVH4_Q61R97G99G104_Fab_S31V
QVQLVQSGSELKKPGASVKVSCKASGYTFTVSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1139 - protein, 120 aa, synthetic construct
  REGION 1..120: note = >huVH4_Q61R97G99G104_Fab_S31W
QVQLVQSGSELKKPGASVKVSCKASGYTFTWSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1140 - protein, 120 aa, synthetic construct
  REGION 1..120: note = >huVH4_Q61R97G99G104_Fab_S31Y
QVQLVQSGSELKKPGASVKVSCKASGYTFTYSGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1141 - protein, 120 aa, synthetic construct
  REGION 1..120: note = >huVH4_Q61R97G99G104_Fab_S32D
QVQLVQSGSELKKPGASVKVSCKASGYTFTSDGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1142 - protein, 120 aa, synthetic construct
  REGION 1..120: note = >huVH4_Q61R97G99G104_Fab_S32E
QVQLVQSGSELKKPGASVKVSCKASGYTFTSEGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1143 - protein, 120 aa, synthetic construct
  REGION 1..120: note = >huVH4_Q61R97G99G104_Fab_S32F
QVQLVQSGSELKKPGASVKVSCKASGYTFTSFGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1144 - protein, 120 aa, synthetic construct
  REGION 1..120: note = >huVH4_Q61R97G99G104_Fab_S32G
QVQLVQSGSELKKPGASVKVSCKASGYTFTSGGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1145 - protein, 120 aa, synthetic construct
  REGION 1..120: note = >huVH4_Q61R97G99G104_Fab_S32H
QVQLVQSGSELKKPGASVKVSCKASGYTFTSHGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1146 - protein, 120 aa, synthetic construct
  REGION 1..120: note = >huVH4_Q61R97G99G104_Fab_S32I
QVQLVQSGSELKKPGASVKVSCKASGYTFTSIGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1147 - protein, 120 aa, synthetic construct
  REGION 1..120: note = >huVH4_Q61R97G99G104_Fab_S32K
QVQLVQSGSELKKPGASVKVSCKASGYTFTSKGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1148 - protein, 120 aa, synthetic construct
  REGION 1..120: note = >huVH4_Q61R97G99G104_Fab_S32L
QVQLVQSGSELKKPGASVKVSCKASGYTFTSLGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1149 - protein, 120 aa, synthetic construct
  REGION 1..120: note = >huVH4_Q61R97G99G104_Fab_S32M
QVQLVQSGSELKKPGASVKVSCKASGYTFTSMGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1150 - protein, 120 aa, synthetic construct
  REGION 1..120: note = >huVH4_Q61R97G99G104_Fab_S32N
QVQLVQSGSELKKPGASVKVSCKASGYTFTSNGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1151 - protein, 120 aa, synthetic construct
  REGION 1..120: note = >huVH4_Q61R97G99G104_Fab_S32P
QVQLVQSGSELKKPGASVKVSCKASGYTFTSPGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1152 - protein, 120 aa, synthetic construct
  REGION 1..120: note = >huVH4_Q61R97G99G104_Fab_S32Q
QVQLVQSGSELKKPGASVKVSCKASGYTFTSQGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1153 - protein, 120 aa, synthetic construct
  REGION 1..120: note = >huVH4_Q61R97G99G104_Fab_S32R
QVQLVQSGSELKKPGASVKVSCKASGYTFTSRGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1154 - protein, 120 aa, synthetic construct
  REGION 1..120: note = >huVH4_Q61R97G99G104_Fab_S32T
QVQLVQSGSELKKPGASVKVSCKASGYTFTSTGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1155 - protein, 120 aa, synthetic construct
  REGION 1..120: note = >huVH4_Q61R97G99G104_Fab_S32V
QVQLVQSGSELKKPGASVKVSCKASGYTFTSVGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1156 - protein, 120 aa, synthetic construct
  REGION 1..120: note = >huVH4_Q61R97G99G104_Fab_S32W
QVQLVQSGSELKKPGASVKVSCKASGYTFTSWGISWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1157 - protein, 120 aa, synthetic construct
  REGION 1..120: note = >huVH4_Q61R97G99G104_Fab_S35D
QVQLVQSGSELKKPGASVKVSCKASGYTFTSSGIDWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1158 - protein, 120 aa, synthetic construct
  REGION 1..120: note = >huVH4_Q61R97G99G104_Fab_S35E
QVQLVQSGSELKKPGASVKVSCKASGYTFTSSGIEWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1159 - protein, 120 aa, synthetic construct
  REGION 1..120: note = >huVH4_Q61R97G99G104_Fab_S35F
QVQLVQSGSELKKPGASVKVSCKASGYTFTSSGIFWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1160 - protein, 120 aa, synthetic construct
  REGION 1..120: note = >huVH4_Q61R97G99G104_Fab_S35G
QVQLVQSGSELKKPGASVKVSCKASGYTFTSSGIGWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1161 - protein, 120 aa, synthetic construct
  REGION 1..120: note = >huVH4_Q61R97G99G104_Fab_S35H
QVQLVQSGSELKKPGASVKVSCKASGYTFTSSGIHWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1162 - protein, 120 aa, synthetic construct
  REGION 1..120: note = >huVH4_Q61R97G99G104_Fab_S35I
QVQLVQSGSELKKPGASVKVSCKASGYTFTSSGIIWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1163 - protein, 120 aa, synthetic construct
  REGION 1..120: note = >huVH4_Q61R97G99G104_Fab_S35K
QVQLVQSGSELKKPGASVKVSCKASGYTFTSSGIKWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1164 - protein, 120 aa, synthetic construct
  REGION 1..120: note = >huVH4_Q61R97G99G104_Fab_S35L
QVQLVQSGSELKKPGASVKVSCKASGYTFTSSGILWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1165 - protein, 120 aa, synthetic construct
  REGION 1..120: note = >huVH4_Q61R97G99G104_Fab_S35M
QVQLVQSGSELKKPGASVKVSCKASGYTFTSSGIMWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1166 - protein, 120 aa, synthetic construct
  REGION 1..120: note = >huVH4_Q61R97G99G104_Fab_S35P
QVQLVQSGSELKKPGASVKVSCKASGYTFTSSGIPWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1167 - protein, 120 aa, synthetic construct
  REGION 1..120: note = >huVH4_Q61R97G99G104_Fab_S35Q
QVQLVQSGSELKKPGASVKVSCKASGYTFTSSGIQWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1168 - protein, 120 aa, synthetic construct
  REGION 1..120: note = >huVH4_Q61R97G99G104_Fab_S35R
QVQLVQSGSELKKPGASVKVSCKASGYTFTSSGIRWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1169 - protein, 120 aa, synthetic construct
  REGION 1..120: note = >huVH4_Q61R97G99G104_Fab_S35T
QVQLVQSGSELKKPGASVKVSCKASGYTFTSSGITWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1170 - protein, 120 aa, synthetic construct
  REGION 1..120: note = >huVH4_Q61R97G99G104_Fab_S35V
QVQLVQSGSELKKPGASVKVSCKASGYTFTSSGIVWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1171 - protein, 120 aa, synthetic construct
  REGION 1..120: note = >huVH4_Q61R97G99G104_Fab_S35W
QVQLVQSGSELKKPGASVKVSCKASGYTFTSSGIWWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1172 - protein, 120 aa, synthetic construct
  REGION 1..120: note = >huVH4_Q61R97G99G104_Fab_S35Y
QVQLVQSGSELKKPGASVKVSCKASGYTFTSSGIYWVRQAPGQGLEWMGEILPRSGYTNYNQGFTGRFVFSADKSVSTAYLQISSLKAEDTAVYYCARDFRSGRYAMDYWGQGTTVTVSS

SEQ ID NO: 1173 - protein, 120 aa, synthetic construct
  REGION 1..120: note = >huVH4_Q61R97G99G104_Fab_Y100aA
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRAAMDYWGQGTTVTVSS

SEQ ID NO: 1174 - protein, 120 aa, synthetic construct
  REGION 1..120: note = >huVH4_Q61R97G99G104_Fab_Y100aD
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRDAMDYWGQGTTVTVSS

SEQ ID NO: 1175 - protein, 120 aa, synthetic construct
  REGION 1..120: note = >huVH4_Q61R97G99G104_Fab_Y100aE
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGREAMDYWGQGTTVTVSS

SEQ ID NO: 1176 - protein, 120 aa, synthetic construct
  REGION 1..120: note = >huVH4_Q61R97G99G104_Fab_Y100aF
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRFAMDYWGQGTTVTVSS

SEQ ID NO: 1177 - protein, 120 aa, synthetic construct
  REGION 1..120: note = >huVH4_Q61R97G99G104_Fab_Y100aG
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRGAMDYWGQGTTVTVSS

SEQ ID NO: 1178 - protein, 120 aa, synthetic construct
  REGION 1..120: note = >huVH4_Q61R97G99G104_Fab_Y100aH
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRHAMDYWGQGTTVTVSS

SEQ ID NO: 1179 - protein, 120 aa, synthetic construct
  REGION 1..120: note = >huVH4_Q61R97G99G104_Fab_Y100aI
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRIAMDYWGQGTTVTVSS

SEQ ID NO: 1180 - protein, 120 aa, synthetic construct
  REGION 1..120: note = >huVH4_Q61R97G99G104_Fab_Y100aK
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRKAMDYWGQGTTVTVSS

SEQ ID NO: 1181 - protein, 120 aa, synthetic construct
  REGION 1..120: note = >huVH4_Q61R97G99G104_Fab_Y100aL
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRLAMDYWGQGTTVTVSS

SEQ ID NO: 1182 - protein, 120 aa, synthetic construct
  REGION 1..120: note = >huVH4_Q61R97G99G104_Fab_Y100aM
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRMAMDYWGQGTTVTVSS

SEQ ID NO: 1183 - protein, 120 aa, synthetic construct
  REGION 1..120: note = >huVH4_Q61R97G99G104_Fab_Y100aN
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRNAMDYWGQGTTVTVSS

SEQ ID NO: 1184 - protein, 120 aa, synthetic construct
  REGION 1..120: note = >huVH4_Q61R97G99G104_Fab_Y100aP
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRPAMDYWGQGTTVTVSS

SEQ ID NO: 1185 - protein, 120 aa, synthetic construct
  REGION 1..120: note = >huVH4_Q61R97G99G104_Fab_Y100aQ
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRQAMDYWGQGTTVTVSS

SEQ ID NO: 1186 - protein, 120 aa, synthetic construct
  REGION 1..120: note = >huVH4_Q61R97G99G104_Fab_Y100aR
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRRAMDYWGQGTTVTVSS

SEQ ID NO: 1187 - protein, 120 aa, synthetic construct
  REGION 1..120: note = >huVH4_Q61R97G99G104_Fab_Y100aS
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRSAMDYWGQGTTVTVSS

SEQ ID NO: 1188 - protein, 120 aa, synthetic construct
  REGION 1..120: note = >huVH4_Q61R97G99G104_Fab_Y100aT
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRTAMDYWGQGTTVTVSS

SEQ ID NO: 1189 - protein, 120 aa, synthetic construct
  REGION 1..120: note = >huVH4_Q61R97G99G104_Fab_Y100aV
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRVAMDYWGQGTTVTVSS

SEQ ID NO: 1190 - protein, 120 aa, synthetic construct
  REGION 1..120: note = >huVH4_Q61R97G99G104_Fab_Y100aW
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFRSGRWAMDYWGQGTTVTVSS

SEQ ID NO: 1191 - protein, 113 aa, synthetic construct
  REGION 1..113: note = >186A3_VL
DIVMTQSPSSLAMSVGQKVTMSCKSSQSLLNSANQKNYLAWYQQKPGQSPRFLIYFASTRESGVPDRFIGSGSGTDFALTISSVQAEDLADYFCQQHYSTPWTFGGGTTLDIK

SEQ ID NO: 1192 - protein, 107 aa, synthetic construct
  REGION 1..107: note = >31D8_VL
DIVMTQSHKFMSTSVGDRVSITCKASQDVRTAVAWYQQKPGQSPKLLIYWASTRHTGVPDRFTGSGSGTDYTLTISSVQAEDLALYYCQQHYSTPLTFGAGTKLELR

SEQ ID NO: 1193 - protein, 107 aa, synthetic construct
  REGION 1..107: note = >62A4_VL
DIQMNQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLEIK

SEQ ID NO: 1194 - protein, 107 aa, synthetic construct
  REGION 1..107: note = >AA_207B7_huVL2_VL
DIVMTQSPDSLAVSLGERATINCKASQSVRYNVAWYQQKPGQPPKLLIYYASNRYSGVPDRFSGSGSGTDFTLTISSLQAEDVAVYYCQQHYNSPLTFGGGTKLEIK

SEQ ID NO: 1195 - protein, 107 aa, synthetic construct
  REGION 1..107: note = >AA_207B7_huVL4_VL
DIQMTQSPSSLSASVGDRVTITCQASQSVRYNVAWYQQKPGKAPKLLIYYASNLYTGVPSRFSGSGSGTDFTFTISSLQPEDIATYYCQQHYNSPLTFGGGTKLEIK

SEQ ID NO: 1196 - protein, 107 aa, synthetic construct
  REGION 1..107: note = >TGEXLC_Human_Kappa_140D6_(LPAR1)
DIVMTQSHKFMSTSVGDRVSITCKASQDVTITVAWYQQKPGQSPKLLIYSASYRYIGVPDRFTGSGSGTDFTFTISSVQAEDLAVYYCQQHYSIPHTFGGGTKLEIK

SEQ ID NO: 1197 - protein, 107 aa, synthetic construct
  REGION 1..107: note = >TGEXLC_Human_Kappa_192E9
DIVMTQSHKFMSTSVGDRVSIICKASQDVSTAVAWYQQKPGQSPKLLIYWASTRHTGVPDRFTGSGSGTDYTLTISSVQAEDLALYYCQQHYRIPLTFGAGTKLELK

SEQ ID NO: 1198 - protein, 107 aa, synthetic construct
  REGION 1..107: note = >TGEXLC_Human_Kappa_92C5/92D12_primary
DIVMTQSHKFMSTSVGDRVSITCKASQDVNTAVAWYQQKPGQSPKLLIYSAFYRYTGVPDRFTGSGSGTDFTFTISSVQAEDLAVYYCQQHYRTPLTFGAGTKLDLK

SEQ ID NO: 1199 - protein, 107 aa, synthetic construct
  REGION 1..107: note = >207B7mGF_H91A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQAYNSPLTFGAGTKLELK

SEQ ID NO: 1200 - protein, 107 aa, synthetic construct
  REGION 1..107: note = >207B7mGF_L96A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYNSPATFGAGTKLELK

SEQ ID NO: 1201 - protein, 107 aa, synthetic construct
  REGION 1..107: note = >207B7mGF_N32A_VL
SIVMTQTPKFLPVSAGDRVTMTCKASQSVRYAVAWYQQKPGQSPKLLIYYASNRYTGVPDRFTGSGSGTDFTFTISSVQVEDLAVYFCQQHYNSPLTFGAGTKLELK

SEQ ID NO: 1202 - protein, 107 aa, synthetic construct
  REGION 1..107: note = >207B7mGF_N93A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYASPLTFGAGTKLELK

SEQ ID NO: 1203 - protein, 107 aa, synthetic construct
  REGION 1..107: note = >207B7mGF_P95A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYNSALTFGAGTKLELK

SEQ ID NO: 1204 - protein, 107 aa, synthetic construct
  REGION 1..107: note = >207B7mGF_Q27A_VL
SIVMTQTPKFLPVSAGDRVTMTCKASASVRYNVAWYQQKPGQSPKLLIYYASNRYTGVPDRFTGSGSGTDFTFTISSVQVEDLAVYFCQQHYNSPLTFGAGTKLELK

SEQ ID NO: 1205 - protein, 107 aa, synthetic construct
  REGION 1..107: note = >207B7mGF_Q90A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQAHYNSPLTFGAGTKLELK

SEQ ID NO: 1206 - protein, 107 aa, synthetic construct
  REGION 1..107: note = >207B7mGF_R30A_VL
SIVMTQTPKFLPVSAGDRVTMTCKASQSVAYNVAWYQQKPGQSPKLLIYYASNRYTGVPDRFTGSGSGTDFTFTISSVQVEDLAVYFCQQHYNSPLTFGAGTKLELK

SEQ ID NO: 1207 - protein, 107 aa, synthetic construct
  REGION 1..107: note = >207B7mGF_S28A_VL
SIVMTQTPKFLPVSAGDRVTMTCKASQAVRYNVAWYQQKPGQSPKLLIYYASNRYTGVPDRFTGSGSGTDFTFTISSVQVEDLAVYFCQQHYNSPLTFGAGTKLELK

SEQ ID NO: 1208 - protein, 107 aa, synthetic construct
  REGION 1..107: note = >207B7mGF_S94A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYNAPLTFGAGTKLELK

SEQ ID NO: 1209 - protein, 107 aa, synthetic construct
  REGION 1..107: note = >207B7mGF_T97A_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYNSPLAFGAGTKLELK

SEQ ID NO: 1210 - protein, 107 aa, synthetic construct
  REGION 1..107: note = >207B7mGF_V29A_VL
SIVMTQTPKFLPVSAGDRVTMTCKASQSARYNVAWYQQKPGQSPKLLIYYASNRYTGVPDRFTGSGSGTDFTFTISSVQVEDLAVYFCQQHYNSPLTFGAGTKLELK

SEQ ID NO: 1211 - protein, 107 aa, synthetic construct
  REGION 1..107: note = >207B7mGF_V33A_VL
SIVMTQTPKFLPVSAGDRVTMTCKASQSVRYNAAWYQQKPGQSPKLLIYYASNRYTGVPDRFTGSGSGTDFTFTISSVQVEDLAVYFCQQHYNSPLTFGAGTKLELK

SEQ ID NO: 1212 - protein, 107 aa, synthetic construct
  REGION 1..107: note = >207B7mGF_Y31A_VL
SIVMTQTPKFLPVSAGDRVTMTCKASQSVRANVAWYQQKPGQSPKLLIYYASNRYTGVPDRFTGSGSGTDFTFTISSVQVEDLAVYFCQQHYNSPLTFGAGTKLELK

SEQ ID NO: 1213 - protein, 107 aa, synthetic construct
  REGION 1..107: note = >AA_207B7_huVL1_VL
SIVMTQSPDSLAVSLGERATINCKASQSVRYNVAWYQQKPGQPPKLLIYYASNRYTGVPDRFSGSGSGTDFTLTISSLQAEDVAVYFCQQHYNSPLTFGGGTKLEIK

SEQ ID NO: 1214 - protein, 107 aa, synthetic construct; identical to SEQ ID NO: 32
  REGION 1..107: note = >LCA_G30R_Q90H_VL

SEQ ID NO: 1215 - protein, 107 aa, synthetic construct
  REGION 1..107: note = >LCA_G30R_VL
SIVMTQTPKFLPVSAGDRVTMTCKASQSVRYNVAWYQQKPGQSPKLLIYYASNRYTGVPDRFTGSGSGTDFTFTISSVQVEDLAVYFCQQHYSSPLTFGAGTKLELK

SEQ ID NO: 1216 - protein, 107 aa, synthetic construct
  REGION 1..107: note = >LCA_Q90H_S93N_VL
SIVMTQTPKFLPVSAGDRVTMTCKASQSVGYNVAWYQQKPGQSPKLLIYYASNRYTGVPDRFTGSGSGTDFTFTISSVQVEDLAVYFCQHHYNSPLTFGAGTKLELK

SEQ ID NO: 1217 - protein, 107 aa, synthetic construct
  REGION 1..107: note = >TGEXLC_Human_Kappa_189A11
SIVMTQTPKFLPVSAGDRVTMTCKASQSVGYNVAWYQQKTGQSPKLLIYYASNRYTGVPDRFTGSGSGTDFTFTISSVQVEDLAVYFCQQHYSSPLTFGAGTKLELK

SEQ ID NO: 1218 - protein, 107 aa, synthetic construct; identical to SEQ ID NO: 874
  REGION 1..107: note = >TGEXLC_Human_Kappa_189B8

SEQ ID NO: 1219 - protein, 214 aa, synthetic construct
  REGION 1..214: note = Artificial sequence
SIQMTQSPSSLSASVGDRVTITCQASQSVRYNVAWYQQKPGKAPKLLIYYASNRYEGVPSRFSGSGSGTDFTFTISSLQPEDIATYFCQHHYSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1220 - protein, 450 aa, synthetic construct
  REGION 1..450: note = Artificial Sequence
QVQLVQSGSELKKPGASVKVSCKASGYTFTSSGISWVRQAPGQGLEWMGEIQPRSGYTNYNQGFTGRFVFSADKSVSTAYLQISSLKAEDTAVYYCARDKGPARYTMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1221 - protein, 214 aa, synthetic construct
  REGION 1..214: note = Artificial Sequence
SIQMTQSPSSLSASVGDRVTITCQASQSIRYNVAWYQQKPGKAPKLLIYYASNRYEGVPSRFSGSGSGTDFTFTISSLQPEDIATYYCQHHYSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1222 - protein, 364 aa, Mus musculus
MAAASTSSPVISQPQFTAMNEQQCFYNESIAFFYNRSGKYLATEWNTVSKLVMGLGITVCVFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIDHCSNMAPLYSDSYLVFWAIFNLVTFVVMVVLYAHIFGYVRQRTMRMSRHSSGPRRNRDTMMSLLKTVVIVLGAFIVCWTPGLVLLLLDVCCPQCDVLAYEKFFLLLAEFNSAMNPIIYSYRDKEMSATFRQILCCQRNENPNGPTEGSDRSASSLNHTILAGVHSNDHSVV

SEQ ID NO: 1223 - protein, 364 aa, Cavia porcellus
MATASTATSVISQPQFTAMNEPQCFYNESIAFFYNRSGKYLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSESTNGPAEGSDRSASSLNHTILAGVHNNDHSVV

SEQ ID NO: 1224 - protein, 364 aa, Oryctolagus cuniculus
MAAASTSTPVISQPQFTAMNEPQCFYNESIAFFYNRSGKYLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIIMGAIPSVGWNCICDIEHCSNMAPLYSESYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSESTSGPAEGSDRSASSLNHTILAGVHSDDHSVV

SEQ ID NO: 1225 - protein, 351 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 1226 - protein, 353 aa, Homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 1227 - protein, 120 aa, synthetic construct
  REGION 1..120: note = Artificial Sequence
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 1228 - protein, 106 aa, synthetic construct
  REGION 1..106: note = Artificial Sequence
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIK

SEQ ID NO: 1229 - DNA, 1092 bp, Homo sapiens
  source 1..1092: mol_type = other DNA
atggccgctattagcaccagcatccccgtgatttcccagccccagttcaccgccatgaacgagccccagtgcttctacaacgagagcatcgccttcttctacaacaggtccggaaagcatctggctaccgagtggaacacagtgagcaagctggtgatgggcctcggcatcacagtgtgcatcttcatcatgctcgccaatctgctcgtgatggtggccatctatgtcaatagaagattccacttccccatctactatctgatggccaacctcgccgccgccgatttctttgccggactggcctacttctatctgatgttcaacaccggccccaacaccagaagactgaccgtcagcacatggctgctgagacaaggactgatcgatacctctctgaccgcctccgtggctaatctgctcgccatcgccatcgagagacacatcaccgtgtttagaatgcagctccacaccagaatgagcaatagaagagtggtggtggtgattgtggtgatctggaccatggccattgtcatgggagccattccctccgtgggatggaactgcatctgcgacatcgagaactgcagcaacatggctcctctctacagcgattcctatctggtgttctgggccatcttcaatctggtgacctttgtggtgatggtcgtcctctacgcccacattttcggctacgtgaggcagaggaccatgagaatgtctagacactcctccggccccagaaggaatagagacacaatgatgtctctgctgaagaccgtggtcattgtgctgggcgccttcatcatctgttggacacccggactggtgctgctgctgctggatgtgtgttgtccccagtgtgacgtcctcgcctacgagaagttttttctgctgctggccgagtttaactccgccatgaaccccatcatctacagctatagagacaaggagatgagcgccacctttagacagattctgtgttgccagagaagcgagaatcccaccggccccaccgaaggcagcgatagaagcgcctcctctctgaatcataccattctggccggagtgcacagcaacgaccatagcgtggtg

SEQ ID NO: 1230 - DNA, 1053 bp, Homo sapiens
  source 1..1053: mol_type = other DNA
atggtgattatgggccagtgctactacaacgagaccatcggcttcttctacaacaacagcggcaaggagctcagctcccactggaggcctaaagacgtggtcgtggtggctctgggactgacagtgagcgtgctggtgctgctcacaaatctgctggtgattgccgccattgccagcaatagaagattccaccagcccatctactatctgctgggcaatctggccgctgctgatctgtttgccggcgtggcctatctgttcctcatgttccacaccggccctagaacagctagactctccctcgagggctggtttctgagacaaggactgctcgacacatctctgaccgccagcgtggctacactgctggctatcgctgtggaaaggcacagaagcgtgatggccgtccagctccattctagactgcctaggggaagagtggtgatgctgatcgtgggagtgtgggtggctgctctgggactgggactgctgcccgcccacagctggcactgtctgtgtgctctggatagatgttctagaatggcccctctgctctctagatcctatctggctgtgtgggctctgtcctctctgctcgtgtttctgctgatggtggccgtctacacaagaatcttcttctacgtgaggaggagggtccagagaatggccgagcacgtgagctgtcatcctagatatagagaaaccacactgtctctggtcaaaaccgtggtgatcattctgggcgcctttgtggtgtgctggacccccggccaagtggtgctgctgctggatggactgggatgcgagagctgcaacgtgctggccgtggagaagtattttctgctgctggccgaagccaattctctggtgaatgctgccgtctacagctgcagagacgccgagatgagaaggacctttagaagactgctgtgctgcgcttgtctgagacagagcacaagagagagcgtgcactacacaagctccgctcaaggcggcgcctccacaaggatcatgctgcccgagaatggccaccctctgatggacagcaccctc

SEQ ID NO: 1231 - DNA, 1059 bp, Homo sapiens
  source 1..1059: mol_type = other DNA
atgaatgagtgccactacgacaagcacatggatttcttctacaaccggtccaacaccgacaccgtggacgattggacaggcaccaagctggtcatcgtgctgtgcgtgggcaccttcttttgcctgttcatcttcttcagcaacagcctcgtgatcgccgccgtgatcaagaaccggaagtttcacttccccttctactacctgctggccaacctggccgctgccgatttctttgccggaatcgcctacgtgttcctgatgttcaacacaggccccgtgtctaagaccctgaccgtgaacagatggttcctgagacagggcctgctggacagctctctgacagccagcctgaccaacctgctggttatcgccgtggaacggcacatgagcatcatgcggatgcgggtgcacagcaacctgaccaagaaaagagtgaccctgctgatcctgctcgtgtgggccattgccatcttcatgggagccgtgcctacactcggctggaactgcctgtgtaacatctccgcctgtagcagcctggctcctatctacagcagatcctacctggtgttctggaccgtgtccaacctgatggccttcctgatcatggtggtggtgtacctgcggatctacgtgtacgtgaagagaaagaccaacgtgctgagccctcacaccagcggcagcatctctcggagaagaacccctatgaagctgatgaagaccgtgatgaccgtgctgggcgccttcgttgtgtgttggacacctggactggtcgtgctgctgctggatggcctgaattgcagacagtgtggcgtgcagcacgtgaagcggtggtttctgcttctggctctgctcaacagcgtggtcaaccccatcatctacagctacaaggacgaggatatgtacggcaccatgaagaaaatgatctgctgcttcagccaagagaaccccgagagaaggcccagcagaatccctagcacagtgctgagcagaagcgacaccggcagccagtacatcgaggacagcatttctcagggcgccgtgtgcaacaagagcacctct

SEQ ID NO: 1232 - DNA, 1092 bp, Mus musculus
  source 1..1092: mol_type = other DNA
atggcagcggccagtaccagcagtccggtcataagtcaaccacaattcacagccatgaacgaacaacaatgtttctacaacgaatccatcgcgttcttctacaacagaagcgggaaatacctggccaccgaatggaacacagtgagtaaactggtgatgggcctcggaatcacggtatgcgtcttcatcatgctggccaacctgctggtaatggtggccatatacgtcaacaggcgcttccacttccccatatactacctcatggcgaacctggccgcagccgacttcttcgccggcctagcctacttctaccttatgtttaacacaggccccaacacccggagactgaccgtgagtacctggctcctcagacaaggactgatcgacaccagcctgacagcgtccgtcgcaaacttactggctatcgccatagaaaggcacatcaccgtattccgcatgcaactacacaccaggatgtctaaccgaagggtggtcgtggtgatcgtggtcatatggacaatggctatcgtgatgggcgcgatccccagcgtcggctggaactgcatatgcgacatcgaccactgcagtaacatggcgcccttatacagtgactcctaccttgtgttctgggccatcttcaaccttgtgaccttcgtcgtcatggtggtgttatacgcccacatcttcgggtacgtgaggcaacgcacaatgaggatgagccgccactcaagtgggcccaggcggaaccgcgacacgatgatgtccctgctgaaaaccgtcgtgatcgtccttggcgcattcatagtctgctggaccccgggactggtactgctgctgctggacgtgtgctgcccccaatgcgacgtgctcgcctacgagaaattcttccttctgcttgccgaattcaacagtgccatgaacccaatcatctacagttaccgggacaaagaaatgtccgcaaccttcagacaaatcctgtgctgccaacgaaacgaaaacccaaacggaccaaccgaaggtagcgacaggagcgccagtagccttaaccacaccatcctagcaggggtgcactccaacgaccacagtgtggtg

SEQ ID NO: 1233 - DNA, 1092 bp, Cavia porcellus
  source 1..1092: mol_type = other DNA
atggccaccgcatccaccgccaccagcgtgatctcccaaccacaattcaccgccatgaacgaaccccaatgcttctacaacgaaagcatagccttcttctacaatcgctcaggcaaatacctggcgacagaatggaacaccgtcagtaaactggtcatgggcctgggaatcacagtgtgcatcttcataatgctcgcgaacctgctagtcatggtagcaatctacgtaaacaggcgcttccacttcccaatctactacctgatggcgaaccttgcagccgccgacttcttcgccggcctggcatacttctaccttatgtttaacacagggcccaacacgagacgcctcaccgtctcaacatggcttctgcgacaaggcttaatagacacctcgctgaccgcatcagtggctaaccttctggccatcgccatcgaacgccacatcaccgtgttccgcatgcaactccacacacgcatgagcaacagaagagtggtcgtggtgattgtggtgatctggacaatggccatcgtgatgggcgccatcccctcagtcggctggaactgcatctgcgacatcgaaaactgctcaaacatggcccctctgtactccgacagttacctggtgttctgggccatcttcaacctagttacattcgtcgtaatggtagtcctctacgcccacatcttcggctacgtgcgccaaagaacaatgcgaatgtcacggcacagcagcgggccgcgcaggaacagagacacgatgatgagcctgctcaaaacagtggtgatcgtgctcggggcattcatcatatgctggacgcccgggctcgtacttcttctcttagacgtgtgctgcccccaatgcgacgtgctggcctacgaaaagttcttcctgctcctggccgaattcaacagtgcgatgaaccccatcatatactcgtaccgggacaaagaaatgagtgccaccttccggcaaatcctttgctgccaaagatcggaatccacgaacggcccagcagaaggcagcgaccgctccgcgtcctcactcaaccacaccatcctcgccggcgtgcacaacaacgaccacagtgtggtg

SEQ ID NO: 1234 - DNA, 1092 bp, Oryctolagus cuniculus
  source 1..1092: mol_type = other DNA
atggccgctgcctcaacgagcacccctgtgatcagtcaaccacaattcacagccatgaacgaaccccaatgcttctataacgaaagtatcgccttcttttacaaccggtccggcaaatacctcgccacagaatggaacaccgtgtcgaaactggtgatgggcttaggcatcaccgtatgcatcttcatcatgctggctaaccttctggtcatggtggcgatctacgtgaaccgcagattccacttccccatctactacctgatggcgaacctggccgcagcggacttcttcgcaggcctggcatacttctacctaatgtttaacacaggcccaaacaccaggcggctcaccgtcagcacctggctgctgaggcaagggttaatcgacacatccctcaccgcaagcgtagccaacctactagccatcgccatcgaaagacacatcacagtcttccggatgcaactgcacacgaggatgtccaaccgccgagtcgtagtcgtcatagtggtaatctggaccatggcgatcatcatgggcgcaatcccttccgtaggctggaactgcatctgcgacatcgaacactgcagtaacatggcgccgttatactcggaaagttacctcgtcttctgggccatattcaacctggtgacattcgtagtaatggtggtgttatacgcgcacatcttcggctacgtgcgacaaagaaccatgaggatgagcaggcactccagcgggccgcgccggaaccgggacacaatgatgagtctcctgaaaacggtggtcatcgtgttgggcgccttcatcatatgctggacccccgggctggtgttacttctcctcgacgtgtgctgcccccaatgcgacgtcctggcgtacgaaaagttcttcctcttgttagcagaattcaacagtgccatgaacccaataatatactcctaccgggacaaagaaatgagtgccaccttccggcagatcctctgctgccaacgcagtgaatccacgagtgggccggcagaagggtcagaccggagcgcgtcatccctgaatcacaccatcctggccggcgtccactccgacgaccactcagtcgtc

SEQ ID NO: 1235 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1236 - protein, 450 aa, synthetic construct
QVQLVQSGSELKKPGASVKVSCKASGYTFTSSGISWVRQAPGQGLEWMGEILPRSGYTNYNQGFTGRFVFSADKSVSTAYLQISSLKAEDTAVYYCARDFKGGRYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1237 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1238 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1239 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1240 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1241 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1242 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1243 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1244 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1245 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1246 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1247 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1248 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1249 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1250 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1251 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1252 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1253 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1254 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1255 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1256 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHYTQKSLSLSPGK

SEQ ID NO: 1257 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1258 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1259 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1260 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1261 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALKFHHTQKSLSLSPGK

SEQ ID NO: 1262 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1263 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1264 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1265 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1266 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1267 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 1268 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 1269 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 1270 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 1271 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 1272 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLAVLHQDWLNGKEYKCKVSNKALPAPIEKTISKAKGQPREPQVYTLPPSRDELTKNQVSLTCLVKGFYPSDIAVAWESNGQPENNYKTTPPVLDSDGSFFLYSKLTVDKSRWQQGNVFSCSVMHEALHAHYTQKSLSLSPGK

SEQ ID NO: 1273 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLAVLHQDWLNGKEYKCKVSNKALPAPIEKTISKAKGQPREPQVYTLPPSRDELTKNQVSLTCLVKGFYPSDIAVAWESNGQPENNYKTTPPVLDSDGSFFLYSKLTVDKSRWQQGNVFSCSVMHEALHAHYTQKSLSLSPGK

SEQ ID NO: 1274 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLAVLHQDWLNGKEYKCKVSNKALPASIEKTISKAKGQPREPQVYTLPPSRDELTKNQVSLTCLVKGFYPSDIAVAWESNGQPENNYKTTPPVLDSDGSFFLYSKLTVDKSRWQQGNVFSCSVMHEALHAHYTQKSLSLSPGK

SEQ ID NO: 1275 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLAVLHQDWLNGKEYKCKVSNKALGAPIEKTISKAKGQPREPQVYTLPPSRDELTKNQVSLTCLVKGFYPSDIAVAWESNGQPENNYKTTPPVLDSDGSFFLYSKLTVDKSRWQQGNVFSCSVMHEALHAHYTQKSLSLSPGK

SEQ ID NO: 1276 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLAVLHQDWLNGKEYKCKVSNKALPAPIEKTISKAKGQPREPQVYTLPPSRDELTKNQVSLTCLVKGFYPSDIAVAWESNGQPENNYKTTPPVLDSDGSFFLYSKLTVDKSRWQQGNVFSCSVMHEALHAHYTQKSLSLSPGK

SEQ ID NO: 1277 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1278 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1279 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTPLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1280 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTPLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1281 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1282 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVDNAKTKPREEQYNSTYRVVSVLQVLHQDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1283 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVDNAKTKPREEQYNSTYRVVSVLQVLHQDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1284 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVDNAKTKPREEQYNSTYRVVSVLQVLHQDWLNGKEYKCKVSNKALPASIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1285 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVDNAKTKPREEQYNSTYRVVSVLQVLHQDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1286 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVDNAKTKPREEQYNSTYRVVSVLQVLHQDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1287 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1288 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1289 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1290 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1291 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1292 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 1293 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 1294 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 1295 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMASRTPEVTCVVVDVSHEDPEVKFNWYVDGVEVHNAKTKPREEQYNSTYRVVSVLTVLAQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 1296 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMASRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 1297 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHIDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1298 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHIDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1299 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHIDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1300 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHIDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1301 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHIDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1302 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHVDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1303 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHVDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1304 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHVDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1305 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHVDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1306 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHVDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 1307 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHITQKSLSLSPGK

SEQ ID NO: 1308 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHITQKSLSLSPGK

SEQ ID NO: 1309 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHITQKSLSLSPGK

SEQ ID NO: 1310 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHITQKSLSLSPGK

SEQ ID NO: 1311 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHITQKSLSLSPGK

SEQ ID NO: 1312 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHVTQKSLSLSPGK

SEQ ID NO: 1313 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHVTQKSLSLSPGK

SEQ ID NO: 1314 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHVTQKSLSLSPGK

SEQ ID NO: 1315 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHVTQKSLSLSPGK

SEQ ID NO: 1316 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHVTQKSLSLSPGK

SEQ ID NO: 1317 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 1318 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 1319 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 1320 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 1321 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPGK

SEQ ID NO: 1322 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1323 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1324 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRTPEVTCVVVDVSHEDPEVKFNWYVDGVEVHNAKTKPREEQYNSTYRVVSVLTPLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1325 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRTPEVTCVVVDVSHEDPEVKFNWYVDGVEVHNAKTKPREEQYNSTYRVVSVLTPLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1326 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYISRTPEVTCVVVDVSHEDPEVKFNWYVDGVEVHNAKTKPREEQYNSTYRVVSVLTPLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1327 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQGGPSVFLFPPKPKDTLYITREPEVTCVVVDVSHEDPEVKFNWYVDGVEVHNAKTKPREEQYNSTYRVVSVLTVLHQDWLNGKEYKCQVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1328 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLPVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1329 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLPVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1330 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLPVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1331 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLPVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1332 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREQYNSTYRVVSVLPVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHYHYTQKSLSLSPGK

SEQ ID NO: 1333 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIVVEWENNGQPENNYKTTPPVLDSDGSFFLYSKLTVDKSRWQQGNVFSCSVMHEALHYHYTQKSLSLSPGK

SEQ ID NO: 1334 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIVVEWENNGQPENNYKTTPPVLDSDGSFFLYSKLTVDKSRWQQGNVFSCSVMHEALHYHYTQKSLSLSPGK

SEQ ID NO: 1335 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIVVEWENNGQPENNYKTTPPVLDSDGSFFLYSKLTVDKSRWQQGNVFSCSVMHEALHYHYTQKSLSLSPGK

SEQ ID NO: 1336 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRNPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIVVEWENNGQPENNYKTTPPVLDSDGSFFLYSKLTVDKSRWQQGNVFSCSVMHEALHYHYTQKSLSLSPGK

SEQ ID NO: 1337 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRNPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIVVEWENNGQPENNYKTTPPVLDSDGSFFLYSKLTVDKSRWQQGNVFSCSVMHEALHYHYTQKSLSLSPGK

SEQ ID NO: 1338 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1339 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1340 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1341 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1342 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1343 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHDAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1344 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHDAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1345 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHDAKTKPREEQYNSTYRVVSVLRVLHVDWLNGKEYKCKVSNKALPASIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1346 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHDAKTKPREEQYNSTYRVVSVLRVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1347 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHDAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1348 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1349 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1350 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1351 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1352 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1353 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1354 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1355 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1356 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1357 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1358 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1359 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1360 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1361 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1362 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1363 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1364 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1365 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPASIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1366 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1367 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 1368 - DNA, 1353 bp, synthetic construct
  source 1..1353: mol_type = other DNA
caagtgcagctggtgcagagcggcagcgagctgaagaagcccggcgctagcgtgaaggtgagctgcaaggcctccggctacaccttcacaagcagcggcatcagctgggtgagacaagcccccggccaaggcctggagtggatgggcgagatcctgcctagaagcggctacaccaactacaaccaaggcttcaccggcagattcgtgttcagcgccgacaagagcgtgagcaccgcctacctgcagatcagcagcctgaaggccgaggacaccgccgtgtactactgcgctagagacaaaggccctagcagatacaccatggactactggggccaaggcaccaccgtgaccgtgagcagcgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagccagcatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1369 - DNA, 1353 bp, synthetic construct
  source 1..1353: mol_type = other DNA
caagtgcagctggtgcagagcggcagcgagctgaagaagcccggcgctagcgtgaaggtgagctgcaaggctagcggctacaccttcacaagcagcggcatcagctgggtgagacaagcccccggccaaggcctggagtggatgggcgagatcctgcctagaagcggctacaccaattacaaccaaggcttcaccggcagattcgtgttcagcgccgacaagagcgtgagcaccgcctacctgcagatcagcagcctgaaggccgaggacaccgccgtgtactactgcgctagagacttcaagggcggcagatacgccatggactactggggccaaggcaccaccgtgaccgtgagcagcgcatccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagccagcatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1370 - DNA, 645 bp, synthetic construct
  source 1..645: mol_type = other DNA
tccatccagatgacacagagccctagcagcctgtctgccagcgtgggagacagagtgaccattacctgtcaggccagccagagcgtgcggtacaatgtggcttggtatcagcagaagcccggcaaggcccctaagctgctgatctactacgccagcaaccggtacgatggcgtgcccagcagattttctggcagcggctctggcaccgacttcaccttcaccataagcagcctgcagcctgaggatatcgccacctacttttgccagcaccactacagcagccctctgacctttggcggcggaacaaagctggaaatcaagcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1371 - DNA, 645 bp, synthetic construct
  source 1..645: mol_type = other DNA
tccattcaaatgacccagagcccctcttctctttccgcctctgttggggaccgggtcactatcacgtgtcaagcatcccaatccgtccgctataatgtggcctggtatcaacaaaagccagggaaagcccccaagctgcttatctattacgcatcaaaccgctatgaaggagtcccgtcgcgattcagcggctcaggttctggtactgattttacattcacaatttctagcttgcaaccggaggacattgctacttacttttgtcaacaccactattcgtccccattgacctttggaggtggcaccaaactcgaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1372 - DNA, 1353 bp, synthetic construct
  source 1..1353: mol_type = other DNA
caagtgcagctggtgcagagcggcagcgagctgaagaagcccggcgctagcgtgaaggtgagctgcaaggctagcggctacaccttcacaagcagcggcatcagctgggtgagacaagcccccggccaaggcctggagtggatgggcgagatcctgcctagaagcggctacaccaattacaaccaaggcttcaccggcagattcgtgttcagcgccgacaagagcgtgagcaccgcctacctgcagatcagcagcctgaaggccgaggacaccgccgtgtactactgcgctagagacttcaagggcggcagatacgccatggactactggggccaaggcaccaccgtgaccgtgagcagcgcgagcacgaaaggtcctagcgtgtttccgttagcccctagcagcaaatccacaagcggcggcaccgccgccttaggctgcctggtgaaggactatttcccggaacccgtcaccgtcagttggaattccggcgccctgacatcgggcgtgcacaccttccccgccgtgttgcagagcagcggcctgtacagcctgagcagcgtggtgaccgtgcctagcagcagcctgggcacacagacctacatctgcaacgtgaaccacaagcctagcaacaccaaggtggacaagaaggtggagcccaagagttgcgacaagactcacacctgccccccctgcccggctccggaggccgccggcggtcctagcgtgttcctgtttccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcctagagaggagcagtacaacagcacctacagagtggtgagcgtgctgaccgtgctgcaccaagactggctgaacggcaaggagtacaagtgcaaggtgagcaacaaggccctgcccgcccccatcgagaagaccatcagcaaggccaaggggcagcctagagagccccaagtgtacaccctgccccctagcagagacgagctgaccaagaaccaagtgagcctgacctgcctcgtgaaaggattctaccctagcgacatcgccgtggagtgggagagcaacgggcagcccgagaacaactacaagaccaccccccccgtgctggacagcgacggcagcttcttcctgtacagcaagctgaccgtggacaagagcagatggcagcaaggcaacgtgttctcttgcagcgtgatgcacgaggccctgcacaaccactacacacagaagagcctgagcctgagccccggcaagtga

SEQ ID NO: 1373 - DNA, 1353 bp, synthetic construct
  source 1..1353: mol_type = other DNA
caagtgcagctggtacaaagtggcagtgaactcaagaagcccggcgcttctgtcaaggtctcttgcaaagccagtggctacacattcacatcctctgggatcagttgggtcagacaggccccgggtcagggtctggagtggatgggggaaatccagcctagaagcggttataccaattataaccagggttttacgggacgctttgttttctcggctgacaagtctgtgtccactgcctatctacaaattagcagcctgaaagctgaggacacggcagtctactactgtgcccgggacaagggtcccgctcgatacacaatggattactggggccaaggcaccaccgtaaccgttagttctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggccgtcctacagtcctcaggactctactccctcagcagcgtggtgaccgtgccctccagcagcttgggcacccagacctacatctgcaacgtgaatcacaagcccagcaacaccaaggtggacaagaaggttgagcccaaatcttgtgacaaaactcacacatgcccaccgtgcccagcacctgaagccgctgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcctccatcgagaaaaccatctccaaagccaaagggcagccccgagaaccacaggtgtacaccctgcccccatcccgggacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaatga

SEQ ID NO: 1374 - DNA, 645 bp, synthetic construct
  source 1..645: mol_type = other DNA
agcattcagatgacacagagccctagcagcctgagcgctagcgtgggcgacagagtgaccatcacctgccaagcctctcagagcatcagatacaacgtggcctggtatcagcagaagcccggcaaggcccccaagctgctgatctactacgctagcaacagatacgagggcgtgcctagcagattcagcggcagcggcagcggcaccgacttcaccttcaccatcagcagcctgcagcccgaggacatcgccacctactactgtcagcaccactacagcagccccctgaccttcggcggcggcaccaagctggagatcaagcgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 1375 - protein, 330 aa, synthetic construct [sequence omitted]

SEQ ID NO: 1376 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1377 - protein, 330 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

The invention claimed is:

1. An antibody which binds to Lysophosphatidic Acid Receptor 1 ("LPAR1"), wherein the antibody is an inhibitor of LPAR1, wherein the antibody comprises three heavy chain CDRs (HCDR1-3) and three light chain CDRs (LCDR1-3), wherein the antibody comprises a HCDR1 comprising the amino acid sequence set forth in SEQ ID NO: 1, a HCDR2 comprising the amino acid sequence set forth in SEQ ID NO: 100, a HCDR3 comprising the amino acid sequence set forth in SEQ ID NO: 101, a LCDR1 comprising the amino acid sequence set forth in SEQ ID NO: 4, a LCDR2 comprising the amino acid sequence set forth in SEQ ID NO: 98 and a LCDR3 comprising the amino acid sequence set forth in SEQ ID NO: 6.

2. The antibody of claim 1, wherein the antibody comprises a heavy chain variable region comprising the amino acid sequence set forth in SEQ ID NO: 102 and a light chain variable region comprising the amino acid sequence set forth in SEQ ID NO: 99.

3. The antibody of claim 2, wherein the antibody comprises a heavy chain comprising the heavy chain variable region comprising the amino acid sequence set forth in SEQ ID NO: 102 and a heavy chain constant region comprising the amino acid sequence as set forth in SEQ ID NO: 1239, and a light chain comprising the light chain variable domain comprising the amino acid sequence set forth in SEQ ID NO: 99 and a light chain constant region comprising the amino acid sequence as set forth in SEQ ID NO: 57.

4. The antibody of claim 1, wherein the antibody is a full-length IgG1 antibody.

5. The antibody of claim 1, wherein the antibody comprises an Fc region that has been mutated to reduce effector function, extend half-life, alter ADCC or improve hinge stability.

6. A pharmaceutical composition comprising the antibody of claim 1, together with a pharmaceutically acceptable diluent or carrier.

7. An antibody which binds to LPAR1, wherein the antibody comprises:

a. two heavy chain polypeptides, wherein each of the heavy chain polypeptides comprises a heavy chain variable region comprising three heavy chain CDRs (HCDR1-3) wherein HCDR1 comprises the amino acid sequence set forth in SEQ ID NO: 1, HCDR2 comprises the amino acid sequence set forth in SEQ ID NO: 100, and HCDR3 comprises the amino acid sequence set forth in SEQ ID NO: 101; and b. two light chain polypeptides, wherein each of the light chain polypeptides comprises a light chain variable region comprising three light chain CDRs (LCDR1-3) wherein LCDR1 comprises the amino acid sequence set forth in SEQ ID NO: 4, LCDR2 comprises the amino acid sequence set forth in SEQ ID NO: 98, and LCDR3 comprises the amino acid sequence set forth in SEQ ID NO: 6; and wherein the antibody is an IgG1 antibody.

8. An antibody which binds to LPAR1, wherein the antibody comprises a. two heavy chain polypeptides, each of the heavy chain polypeptides comprising a heavy chain variable region comprising the amino acid sequence set forth in SEQ ID NO: 102; and b. two light chain polypeptides, each of the light chain polypeptides comprising a light chain variable domain comprising the amino acid sequence set forth in SEQ ID NO: 99; and wherein the antibody is an IgG1 antibody.

9. An antibody which binds to LPAR1, wherein the antibody comprises two heavy chain polypeptides and two light chain polypeptides, wherein each of the heavy chain polypeptides comprises the amino acid sequence set forth in SEQ ID NO: 1220 and each of the light chain polypeptides comprises the amino acid sequence set forth in SEQ ID NO: 1219, provided that the residue corresponding to position 255 of SEQ ID NO: 1220 is "Y", the residue corresponding to position 257 of SEQ ID NO: 1220 is "T" and the residue corresponding to position 259 of SEQ ID NO: 1220 is "E".

\* \* \* \* \*